(12) United States Patent
Tan et al.

(10) Patent No.: US 7,605,251 B2
(45) Date of Patent: Oct. 20, 2009

(54) COMPOSITIONS AND METHODS FOR INHIBITING EXPRESSION OF THE PCSK9 GENE

(75) Inventors: Pamela Tan, Kulmbach (DE); Birgit Bramlage, Kulmbach (DE); Maria Frank-Kamenetsky, Brookline, MA (US); Kevin Fitzgerald, Brookline, MA (US); Akin Akinc, Needham, MA (US); Victor E. Kotelianski, Boston, MA (US)

(73) Assignee: Alnylam Pharmaceuticals, Inc., Cambridge, MA (US)

(*) Notice: Subject to any disclaimer, the term of this patent is extended or adjusted under 35 U.S.C. 154(b) by 0 days.

(21) Appl. No.: 11/746,864

(22) Filed: May 10, 2007

(65) Prior Publication Data

US 2008/0113930 A1    May 15, 2008

Related U.S. Application Data

(60) Provisional application No. 60/799,458, filed on May 11, 2006, provisional application No. 60/817,203, filed on Jun. 27, 2006, provisional application No. 60/840,089, filed on Aug. 25, 2006, provisional application No. 60/829,914, filed on Oct. 18, 2006, provisional application No. 60/901,134, filed on Feb. 13, 2007.

(51) Int. Cl.
*A01N 43/04* (2006.01)
*A61K 31/70* (2006.01)
*C07H 21/02* (2006.01)
*C07H 21/04* (2006.01)

(52) U.S. Cl. .................... 536/24.5; 536/23.1; 536/24.3; 514/44

(58) Field of Classification Search ................. 536/3.1, 536/24.3, 24.33, 24.5; 435/6, 91.1, 325, 435/375
See application file for complete search history.

(56) References Cited

U.S. PATENT DOCUMENTS 6,054,299 A    4/2000    Conrad
6,271,359 B1   8/2001    Norris et al.

FOREIGN PATENT DOCUMENTS

DE    10100586 C1    11/2002

(Continued)

OTHER PUBLICATIONS

Gensberg et al., "Subtilin-Related Serine Proteases in the Mammalian Constitutive Secretory Pathway", Seminars in Cell and Developmental Biology, 1998, vol. 9, pp. 11-17.

(Continued)

*Primary Examiner*—Sean McGarry
*Assistant Examiner*—Terra Cotta Gibbs
(74) *Attorney, Agent, or Firm*—Fenwick & West LLP

(57) ABSTRACT

The invention relates to a double-stranded ribonucleic acid (dsRNA) for inhibiting the expression of the proprotein convertase subtilisin kexin 9 (PCSK9) gene, comprising an antisense strand having a nucleotide sequence which is less than 30 nucleotides in length, generally 19-25 nucleotides in length, and which is substantially complementary to at least a part of the PCSK9 gene. The invention also relates to a pharmaceutical composition comprising the dsRNA together with a pharmaceutically acceptable carrier; and methods for treating diseases caused by PCSK9 gene expression by using the pharmaceutical composition.

20 Claims, 9 Drawing Sheets

ND98 Isomer I

FOREIGN PATENT DOCUMENTS

| WO | WO 96/40964 A2 | 12/1996 |
|---|---|---|
| WO | WO 99/32619 A1 | 7/1999 |
| WO | WO 99/53050 A1 | 10/1999 |
| WO | WO 99/61631 A1 | 12/1999 |
| WO | WO 00/22113 A1 | 4/2000 |
| WO | WO 00/22114 A1 | 4/2000 |
| WO | WO 00/44895 A1 | 8/2000 |
| WO | WO 2004/065601 A2 | 8/2004 |

OTHER PUBLICATIONS

Seidah et al., "Proprotein and Prohormone Convertases: A Family of Subtilases Generating Diverse Bioactive Polypeptides", Brain Research, 1999, pp. 45-62.

Leren, "Mutations in the PCSK9 Gene in Norwegian Subjects with Autosomal Dominant Hypercholesterolemia", Clinical Genetics, 2004, pp. 419-422.

Shioji et al., "Genetic Variants in PCSK9 Affect the Cholesterol Level in Japanese", J. Hum Genet, 2004, pp. 109-114.

J.C. Cohen et al., "Molecular Mechanisms of Autosomal Recessive Hypercholesterolemia", Current Opinion in Lipidology, 2003, 14, pp. 121-127.

Cohen et al, "Low LDL Cholesterol in Individuals of African Descent Resulting from Frequent Mutations in PCSK9", Nature Genetics, 2005, 37, pp. 161-165.

Yang et al., "Evidence that Processed Small dsRNAs May Mediate Sequence-Specific mRNA Degradation During RNAi in Drosophila Embryos", Current Biology, 2000, pp. 1191-1200.

Abifadel et al., "Mutations in PCSK9 Cause Autosomal Dominant Hypercholesterolemia", Nature Genetics, 2003, 34, pp. 154-156.

Li et al., "Folate-Mediated Targeting of Antisense Oligodeoxynucleotides to Ovarian Cancer Cells", Phar. Research, 1998, 15, pp. 1540-1545.

Templeton et al., "Improved DNA: Liposome Complexes for Increased Systemic Delivery and Gene Expression", Nature Biotechnology, 1997, 15, pp. 647-652.

Morrissey et al., "Potent and Persistent in Vivo Anti-HBV Activity of Chemically Modified siRNAs", Nature Biotechnology, 2005, 23, pp. 1002-1007.

Couture et al., "Anti-gene Therapy: The Use of Ribozymes to Inhibit Gene Function", TIG, 1996, 12, pp. 510-515.

Bergeron et al., "Subtilase-Like Pro-Protein Convertases: from Molecular Specificity to Therapeutic Applications", Journal of Molecular Endocrinology, 2000, 24, pp. 1-22.

Taylor et al., "Curbing Activation:proprotein Convertases in Homeostasis and Pathology", FASEB, 17, pp. 1215-1227.

Maxwell et al., "Novel Putative SREBP and LXR Target Genes Identified by Microarray Analysis in Liver of Cholesterol-Fed Mice", Journal of Lipid Research, 2003, 44, pp. 2109-2119.

Dubuc et al., Arteriosclerosis, Thrombosis, and Vascular Biology, Journal of the American Heart Association, 2004, 24, pp. 1454-1459.

Zhou et al., Proteolytic Processing in the Secretory Pathway, Journal of Biological Chemistry, 1999, 274, pp. 20745-12032.

Timms et al., "A Mutation in PCSK9 Causing Autosomal-Dominant Hypercholesterolemia in a Utah Pedigree", Humm Genet, 2004, 114, pp. 349-353.

Maxwell et al., "Adenoviral-Mediated Expression of Pcsk9 in Mice Results in a Low-Density LipoProtein Receptor Knockout Phenotype", Proc. Acad. Sci. USA, 2004, 101, 7100-7105.

Rader et al., "Monogenic Hypercholesterolemia: New Insights in Pathogenesis and Treatment", Journal of Clinical Investigation, 2003, 111, pp. 1795-1803.

Benjannet et al., "NARC-1/PCSK9 and it's Natural Mutants", Journal of Biological Chemistry, 2004, 279, pp. 48865-48875.

Park et al., "Post-Transcriptional Regulation of Low Density Lipoprotein Receptor Protein by Proprotein Convertase Subtilisin/Kexin Type 9a in Mouse Liver", Journal of Biological Chemistry, 2004, 279, pp. 50630-50638.

Rashis et al., "Decreased Plasma Cholesterol and Hypersensitivity to Statins in Mice Lacking Pcsk9", PNAS, 2005, 102, pp. 5374-5379.

Cohen et al., "Sequence Variations in PCSK9, Low LDL, and Protection Against Coronary Heart Disease", New England Journal of Medicine, 2006, 354, pp. 1264-1272.

Gassman et al., "Maintenance of an Extrachromosomal Plasmid Vector in Mouse Embryonic Stem Cells", Proc. Natl. Acad, Sci., 1995, 92, pp. 1292-1296.

Elbashir et al., "Functional Anatomy of siRNAs for Mediating Efficient RNAi in *Drosophila melanogaster* Embryo Lysate", 2001, 20, pp. 6877-6888.

Manoharan, "Oligonucleotide Conjugates as Potential Antisense Drugs with Improved Uptake, Biodistribution, Targeted Delivery, and Mechanism of Action", Antisense & Nucleic Acid Drug Development, 2002, 12 pgs. 103-128.

NM 174936, NCBI, 2006, pp. 1-5.

NM 153565, NCBI, 2006, pp. 1-4.

NM 199253, NCBI, 2006, pp. 1-4.

Basek, "Inhibitors of Proprotein Convertases". Journal of Molecular Medicine, 2002, 83, pp. 844-855.

Graham et al., "Antisense Inhibition of Proprotein Convertase Subtilism/Kexin Type 9 Reduces Serum LDL in Hyperlipidemix Mice", Journal of Lipid Research, 2007, 48, pp. 767-769.

Lu et al., "Delivering siRNA in Vivo for Functional Genomics and Novel Therapeutics in RNA Interference Technology", Cambridge, Appasani, 2005, pp. 303-317.

Downward, "Science, Medicine, and the Future RNA Interference", BMJ, 328, pp. 1245-1248.

Samarsky et al., "RNAi in Drug development: Practical Considerations in RNA Interference Technology", Cambridge, Appasani, 2005, pp. 384-395.

Graham et al., "Antisense inhibition of proprotein convertase subtilisin/kexin type 9 reduces serum LDL in hyperlipidemic mice," Journal of Lipid Research, 48: 763-767 (2007).

Genbank Accession No. NM_174936. *Homo sapiens* proprotein convertase subtilisin/kexin type 9 (PCSK9), mRNA. Sep. 30, 2007, p. 1-5.

International Search Report and the Written Opinion for PCT/US07/68655 dated Oct. 29, 2007.

FIG. 7 (panel a and b)

COMPOSITIONS AND METHODS FOR INHIBITING EXPRESSION OF THE PCSK9 GENE

CROSS-REFERENCE TO RELATED APPLICATIONS

This application claims priority to U.S. Provisional Application No. 60/799,458, filed May 11, 2006; U.S. Provisional Application No. 60/817,203, filed Jun. 27, 2006; U.S. Provisional Application No. 60/840,089, filed Aug. 25, 2006; U.S. Provisional Application No. 60/829,914, filed Oct. 18, 2006; and U.S. Provisional Application No. 60/901,134, filed Feb. 13, 2007. The contents of all of these provisional applications are hereby incorporated by reference in their entirety.

FIELD OF THE INVENTION

This invention relates to double-stranded ribonucleic acid (dsRNA), and its use in mediating RNA interference to inhibit the expression of the PCSK9 gene and the use of the dsRNA to treat pathological processes which can be mediated by down regulating PCSK9, such as hyperlipidemia.

BACKGROUND OF THE INVENTION

Proprotein convertase subtilisin kexin 9 (PCSK9) is a member of the subtilisin serine protease family. The other eight mammalian subtilisin proteases, PCSK1-PCSK8 (also called PC1/3, PC2, furin, PC4, PC5/6, PACE4, PC7, and S1P/SKI-1) are proprotein converges that process a wide variety of proteins in the secretory pathway and play roles in diverse biological processes (Bergeron, F. (2000) *J. Mol. Endocrinol.* 24, 1-22, Gensberg, K., (1998) *Semin. Cell Dev. Biol.* 9, 11-17, Seidah, N. G. (1999) *Brain Res.* 848, 45-62, Taylor, N. A., (2003) *FASEB J.* 17, 1215-1227, and Zhou, A., (1999) *J. Biol. Chem.* 274, 20745-20748). PCSK9 has been proposed to play a role in cholesterol metabolism. PCSK9 mRNA expression is down-regulated by dietary cholesterol feeding in mice (Maxwell, K, N., (2003) *J. Lipid Res.* 44, 2109-2119), up-regulated by statins in HepG2 cells (Dubuc, G., (2004) *Arterioscler. Thromb. Vase. Biol.* 24, 1454-1459), and up-regulated in sterol regulatory element binding protein (SREBF) transgenic mice (Horton, J, D., (2003) *Proc. Natl. Acad. Sci. USA* 100, 12027-12032), similar to the cholesterol biosynthetic enzymes and the low-density lipoprotein receptor (LDLR). Furthermore, PCSK9 missense mutations have been found to be associated with a form of autosomal dominant hypercholesterolemia (Hchola3) (Abifadel, M., et at (2003) *Nat. Genet,* 34, 154-156, Timms, K. M., (2004) *Hum. Genet* 114, 349-353, Leren, T. P. (2004) *Clin. Genet.* 65, 419-422), PCSK9 may also play a role in determining LDL cholesterol levels in the general population, because single-nucleotide polymorphisms (SNPs) have been associated with cholesterol levels in a Japanese population (Shioji, K., (2004) *J. Hum. Genet.* 49, 109-114).

Autosomal dominant hypercholesterolemias (ADHs) are monogenic diseases in which patients exhibit elevated total and LDL cholesterol levels, tendon xanthomas, and premature atherosclerosis (Rader, D. J., (2003) *J. Clin. Invest.* 111, 1795-1803). The pathogenesis of ADHs and a recessive form, autosomal recessive hypercholesterolemia (ARH) (Cohen, J. C., (2003) *Curr. Opin. Lipidol.* 14, 121-127), is due to defects in LDL uptake by the liver. ARH may be caused by LDLR mutations, which prevent LDL uptake, or by mutations in the protein on LDL, apolipoprotein B, which binds to the LDLR. ARH is caused by mutations in the ARM protein that are necessary for endocytosis of the LDLR-LDL complex via its interaction with clathrin. Therefore, if PCSK9 mutations are causative in Hchola3 families, it seems likely that PCSK9 plays a role in receptor-mediated LDL uptake.

Overexpression studies point to a role for PCSK9 in controlling LDLR levels and, hence, LDL uptake by the liver (Maxwell K. N. (2004) *Proc. Natl. Acad. Sci. USA* 101, 7100-7105, Benjannet, S., et al. (2004) *J. Biol. Chem.* 279, 48865-18875, Park, S. W., (2004) *J. Biol. Chem.* 279, 50630-50638). Adenoviral-mediated overexpression of mouse or human PCSK9 for 3 or 4 days in mice results in elevated total and LDL cholesterol levels; this effect is not seen in LDLR knockout animals (Maxwell K. N. (2004) *Proc. Natl. Acad. Sci. USA* 101, 7100-7105, Benjannet, S., et al. (2004) *J. Biol. Chem.* 279, 48865-48875, Park, S. W., (2004) *J. Biol. Chem.* 279, 50630-50638). In addition, PCSK9 overexpression results in a severe reduction in hepatic LDLR protein, without affecting IDLE mRNA levels, SREBP protein levels, or SREBP protein nuclear to cytoplasmic ratio. These results indicate that PCSK9, either directly or indirectly, reduces LDLR protein levels by a post transcriptional mechanism Loss of function mutations in PCSK9 have been designed in mouse models (Rashid et al., (2005) *PNAS,* 102, 5374-5379, and identified in human individuals Cohen et al., (2005), Nature Genetics., 37.161-165. In both cases loss of PCSK9 function lead to lowering of total and LDLc cholesterol. In a retrospective outcome study over 15 years, loss of one copy of PCSK9 was shown to shift LDLc lower and to lead to an increased risk-benefit protection from developing cardiovascular heart disease (Cohen et al. 2006 N. Engl. J. Med., 354, 1264-1272.). Clearly the evidence to date indicates that lowering of PCSK9 levels will lower LDLc.

Recently, double-stranded RNA molecules (dsRNA) have been shown to block gene expression in a highly conserved regulatory mechanism known as RNA interference (RNAi), WO 99/32619 (Fire et al.) discloses the use of a dsRNA of at least 25 nucleotides in length to inhibit the expression of genes in *C. elegans*. dsRNA has also been shown to degrade target RNA in other organisms, including plants (see, e.g., WO 99/53050, Waterhouse et al.; and WO 99/61631. Heifetz et al.), *Drosophila* (see, e.g., Yang, D., et al., *Curr. Biol.* (2000) 10:1191-1200), and mammals (see WO 00/44895, Limmer; and DE 101 00 586.5, Kreutzer et al). This natural mechanism has now become the focus for the development of a new class of pharmaceutical agents for treating disorders that are caused by the aberrant or unwanted regulation of a gene.

Despite significant advances in the field of RNAi and advances in the treatment of pathological processes which can be mediated by down regulating PCSK9 gene expression, there remains a need for agents that can inhibit PCSK9 gene expression and that can treat diseases associated with PCSK9 gene expression such as hyperlipidemia.

SUMMARY OF THE INVENTION

The invention provides a solution to the problem of treating diseases that can be modulated by down regulating the proprotein convertase subtilisin kexin 9 (PCSK9) by using double-stranded ribonucleic acid (dsRNA) to silence PCSK9 expression.

The invention provides double-stranded ribonucleic acid (dsRNA), as well as compositions and methods for inhibiting the expression of the PCSK9 gene in a cell or mammal using such dsRNA. The invention also provides compositions and methods for treating pathological conditions that, can modulated by down regulating the expression of the PCSK9 gene, such as hyperlipidemia. The dsRNA of the invention comprises an RNA strand (the antisense strand) having a region which is less than 30 nucleotides in length, generally 19-24 nucleotides in length, and is substantially complementary to at least part of an mRNA transcript of the PCSK9 gene.

In one embodiment, the invention provides double-stranded ribonucleic acid (dsRNA) molecules for inhibiting the expression of the PCSK9 gene. The dsRNA comprises at least two sequences that are complementary to each other. The dsRNA comprises a sense strand comprising a first sequence and an antisense strand comprising a second sequence. The antisense strand comprises a nucleotide sequence which is substantially complementary to at least part of an mRNA encoding PCSK9, and the region of complementarity is less than 30 nucleotides in length, generally 19-24 nucleotides in length. The dsRNA, upon contacting with a cell expressing the PCSK9, inhibits the expression of the PCSK9 gene by at least 40%.

For example, the dsRNA molecules of the invention can be comprised of a first sequence of the dsRNA that, is selected from the group consisting of the sense sequences of Table 1 and Table 2 the second sequence is selected from the group consisting of the antisense sequences of Tables 1 and Table 2. The dsRNA molecules of the invention can be comprised of naturally occurring nucleotides or can be comprised of at least one modified nucleotide, such as a 2'-O-methyl modified nucleotide, a nucleotide comprising a 5'-phosphorothioate group, and a terminal nucleotide linked to a cholesteryl derivative. Alternatively, the modified nucleotide may be chosen from the group of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide. Generally, such modified sequence will be based on a first sequence of said dsRNA selected from the group consisting of the sense sequences of Tables 1 and Table 2 and a second sequence selected from the group consisting, of the antisense sequences of Tables 1, and Table 2.

In another embodiment, the invention provides a cell comprising one of the dsRNAs of the invention. The cell is generally a mammalian cell, such as a human cell.

in another embodiment, the invention provides a pharmaceutical composition for inhibiting the expression of the PCSK9 gene in an organism, generally a human subject, comprising one or more of the dsRNA of the invention and a pharmaceutically acceptable carrier or delivery vehicle.

In another embodiment, the invention provides a method for inhibiting the expression of the PCSK9 gene in a cell, comprising the following steps:

(a) introducing into the cell a double-stranded ribonucleic acid (dsRNA), wherein the dsRNA comprises at least two sequences that are complementary to each, other. The dsRNA comprises a sense strand comprising a first sequence and an antisense strand comprising a second sequence. The antisense strand comprises a region of complementarity which is substantially complementary to at least a part of a mRNA encoding PCSK9, and wherein the region of complementarity is less than 30 nucleotides in length, generally 19-24 nucleotides in length, and wherein the dsRNA, upon contact with a cell expressing the PCSK9, inhibits expression of the PCSK9 gene by at least 40%; and (b) maintaining the cell produced in step (a) for a time sufficient to obtain degradation of the mRNA transcript of the PCSK9 gene, thereby inhibiting expression of the PCSK9 gene in the cell.

In another embodiment, the invention provides methods for treating, preventing or managing pathological processes which can be mediated by down regulating PCSK9 gene expression, e.g. hyperlipidemia, comprising administering to a patient in need of such treatment, prevention or management a therapeutically or prophylactically effective amount of one or more of the dsRNAs of the invention.

In another embodiment, the invention provides vectors for inhibiting the expression of the PCSK9 gene in a cell, comprising a regulatory sequence operably linked to a nucleotide sequence that encodes at least one strand of one of the dsRNA of the invention.

In another embodiment, the invention provides a cell comprising a vector for inhibiting the expression of the PCSK9 gene in a cell. The vector comprises a regulatory sequence operably linked to a nucleotide sequence mat encodes at least one strand of one of the dsRNA of the invention.

Silencing of PCSK9 mRNA resulted in lowering total serum cholesterol levels.

The most efficacious in terms of knocking down PCSK9 message siRNAs showed the most pronounced cholesterol lowering effect (around 20-30%).

Figure 4:
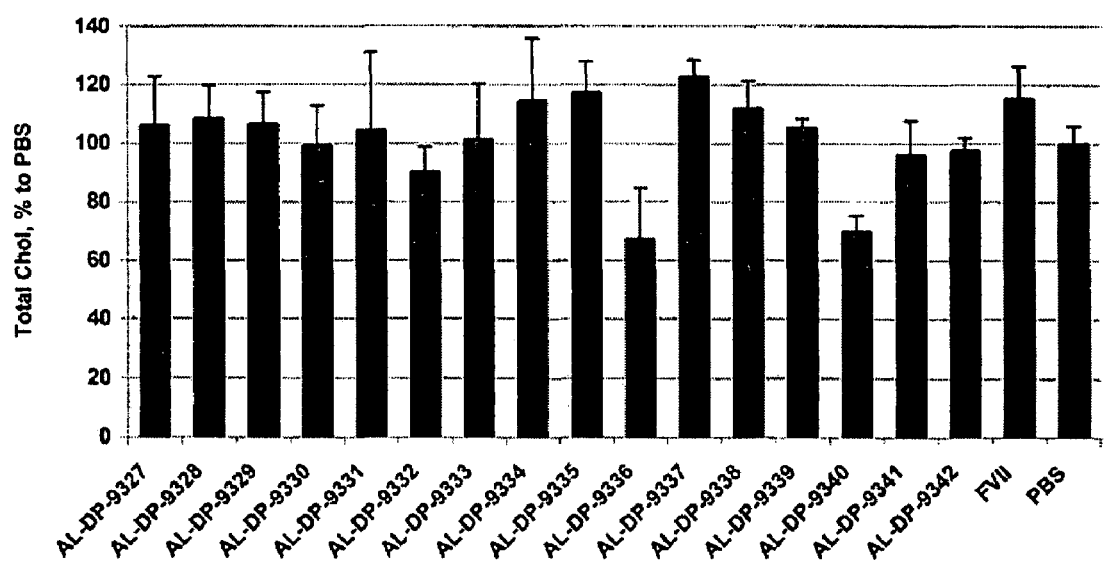

FIG. 4 shows the results of the in vivo screen of 16 mouse specific (AL-DP-9327 through AL-DP-9342) PCSK9 siRNAs in C57/BL6 mice (5 animals/group). Total serum cholesterol levels were averaged over each treatment group and compared to a control group treated with PBS or a control group treated with an unrelated siRNA (blood coagulation factor VII).

Figure 5:
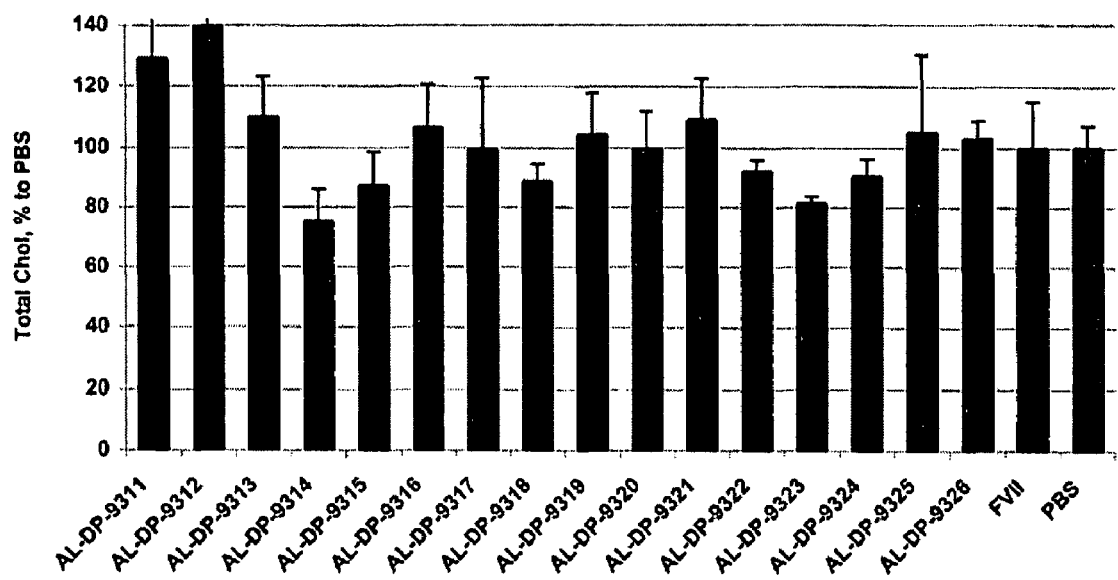

FIG. 5 shows the results of the in viva screen of 16 human/mouse/rat crossreactive (AL-DP-9311 through AL-DP-9326) PCSK9 siRNAs in C57/BL6 mice (5 animals/group). Total serum cholesterol levels were averaged over each treatment group and compared to a control group treated with PBS or a control group treated with an unrelated siRNA (blood coagulation factor VII).

Figure 6:
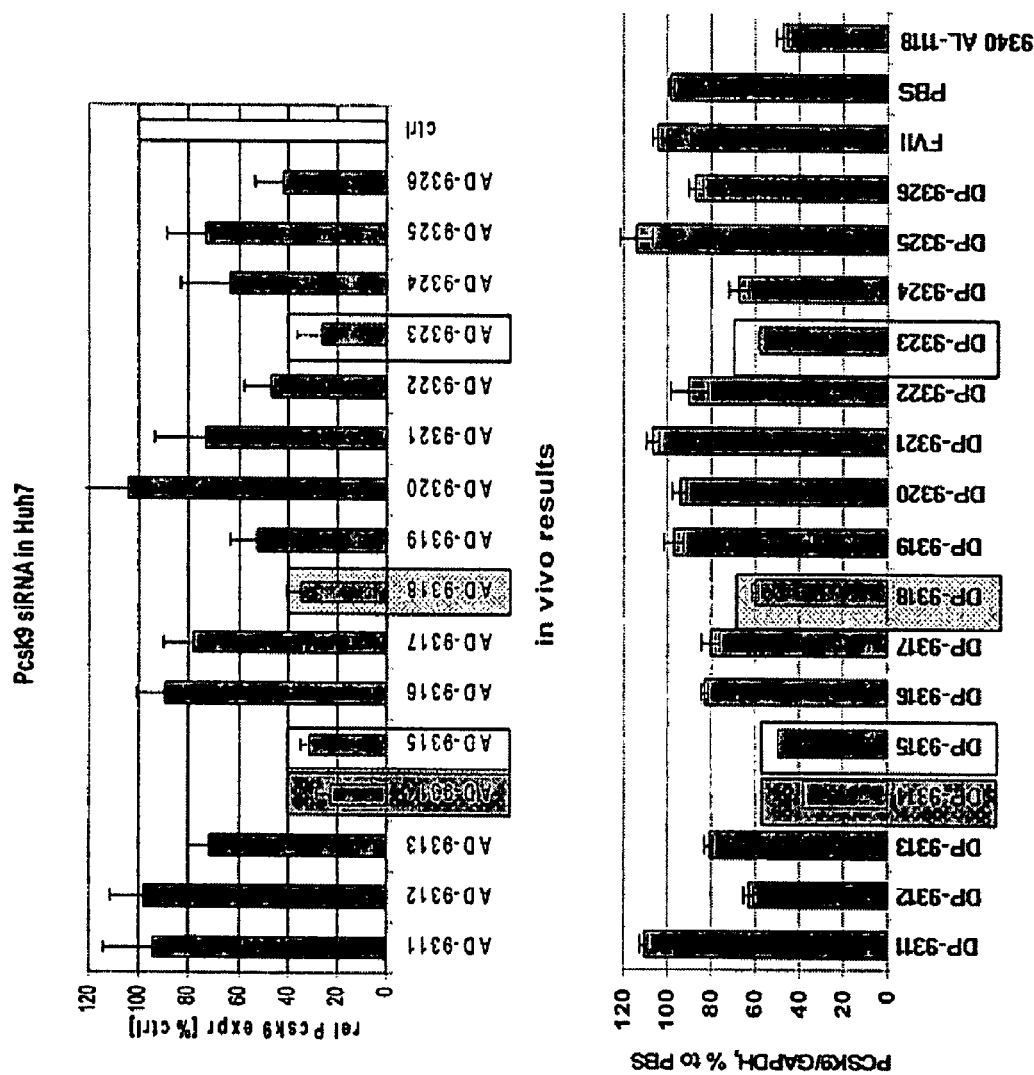

FIG. 6 shows a comparison of the in vitro and in vivo results for silencing PCSK9.

Figure 7A:
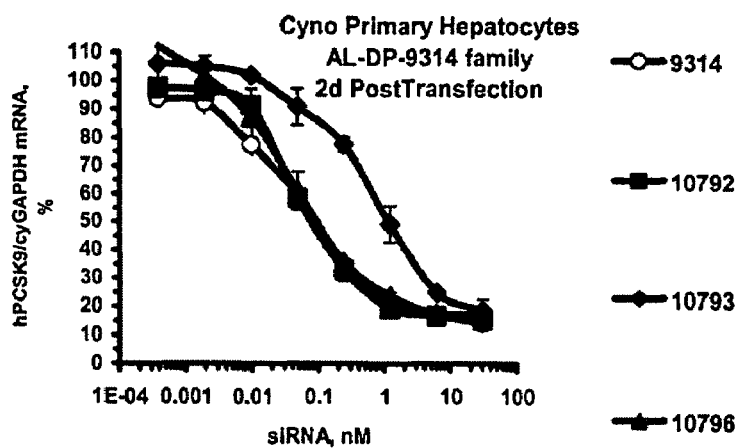
Figure 7B:
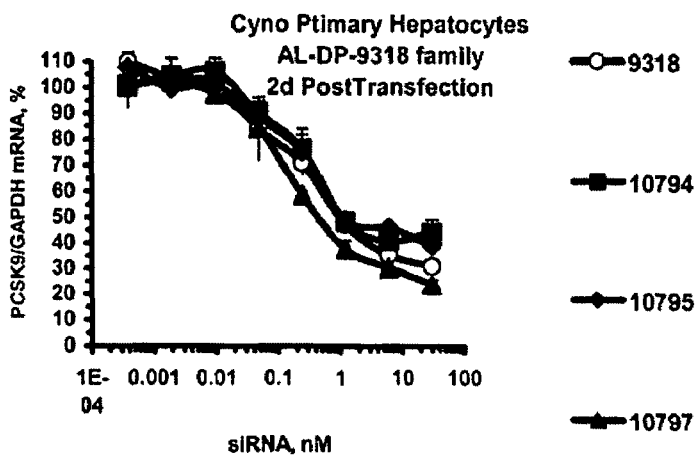

FIG. 7A and FIG. 7B show in vitro results for silencing PCSK9 using monkey primary hepatocytes.

Figure 8:
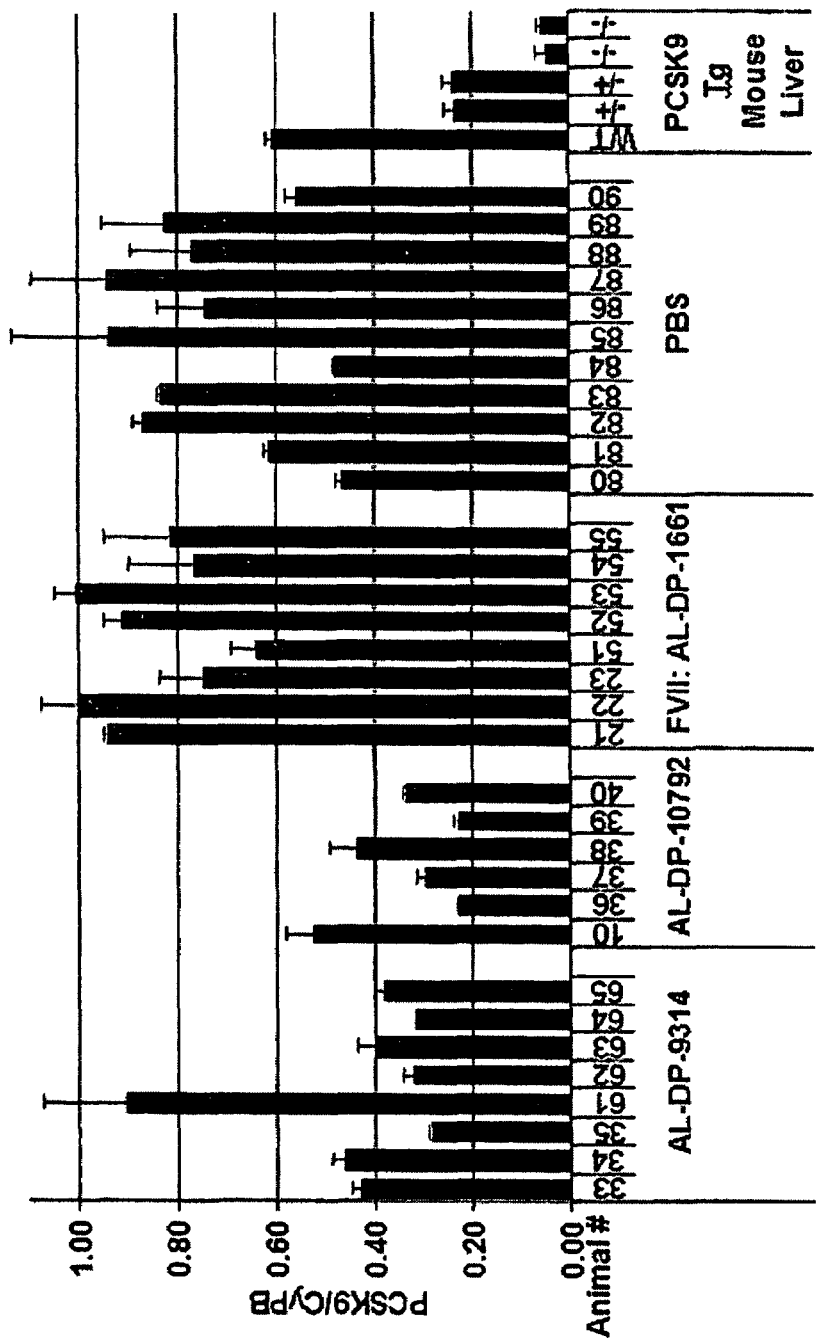

FIG. 8 shows in vivo activity of LNP-01 formulated siRNAs to pcsk-9.

Figure 9:
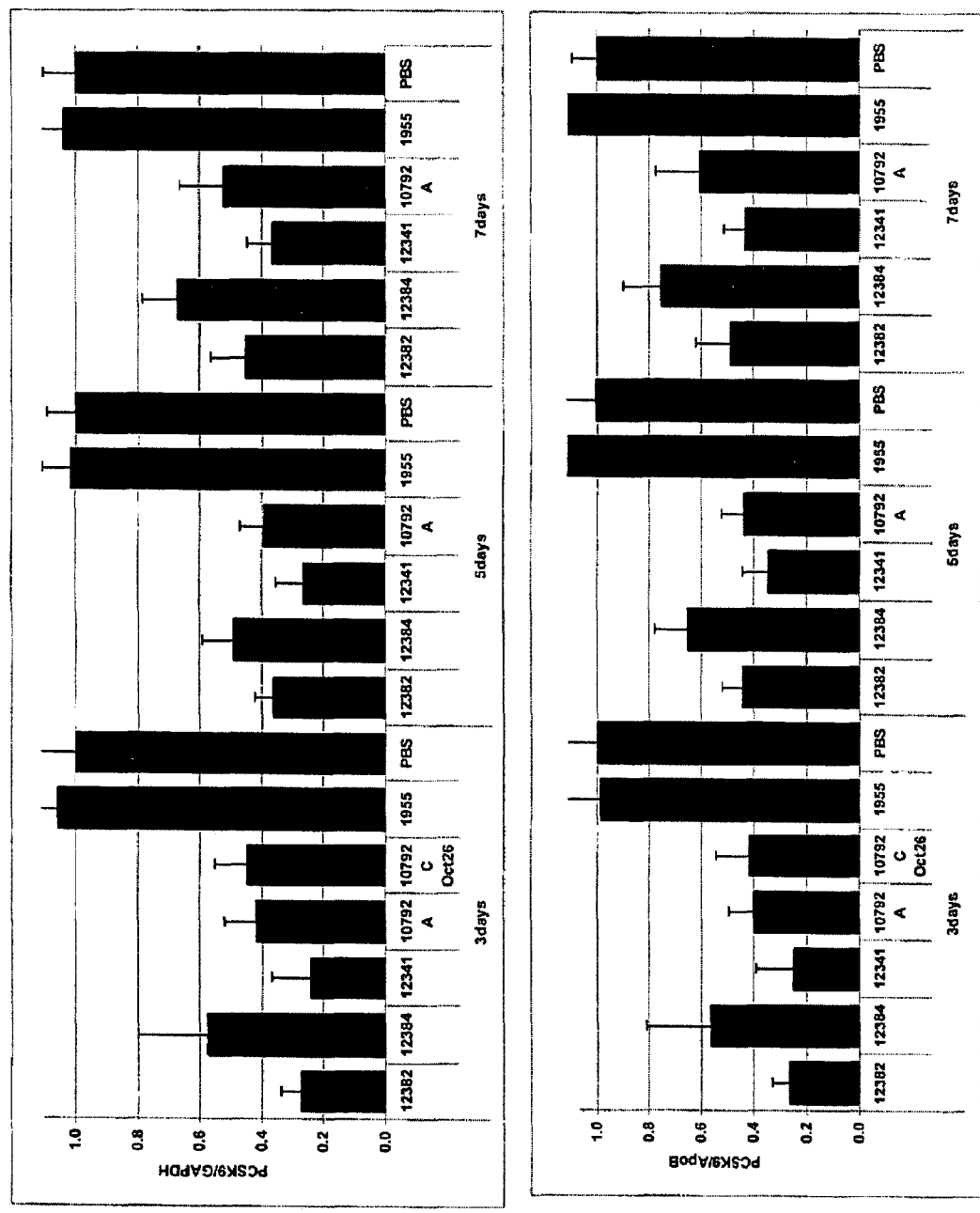

FIG. 9 shows in vivo activity of LNP-01 Formulated chemically modified 9314 and 10792 parent molecules at different times. Clearly modified versions of 10792 display in vivo silencing activity.

DETAILED DESCRIPTION OF THE INVENTION

The invention provides a solution to the problem of treating diseases that can be modulated by the down regulation of the PCSK9 gene, by using double-stranded ribonucleic acid (dsRNA) to silence the PCSK9 gene thus providing treatment for diseases such as hyperlipidemia.

The invention provides double-stranded ribonucleic acid (dsRNA), as well as compositions and methods for inhibiting the expression of the PCSK9 gene in a cell or mammal using the dsRNA. The invention also provides compositions and methods for treating pathological conditions and diseases that can be modulated by down regulating the expression of the PCSK9 gene dsRNA directs the sequence-specific degradation of mRNA through a process known as RNA interference (RNAi).

The dsRNA of die invention comprises an RNA strand (the antisense strand) having a region which is less than 30 nucleotides in length, generally 19-24 nucleotides in length, and is substantially complementary to at least past of an mRNA transcript of the FCSK9 gene. The use of these dsRNAs enables the targeted degradation of an mRNA that is involved in sodium transport. Using cell-based and animal assays, the present inventors have demonstrated that very low dosages of these dsRNA can specifically and efficiently mediate RNAi, resulting in significant inhibition of expression of the PCSK9 gene. Thus, the methods and compositions of the invention comprising these dsRNAs are useful for treating pathological processes which can be mediated by down regulating PCSK9, such as in the treatment of hyperlipidemia.

The following detailed description discloses how to make and use the dsRNA and compositions containing dsRNA to inhibit the expression of the target FCSK9 gene, as well as compositions and methods for treating diseases that can be modulated by down regulating the expression of PCSK9, such as hyperlipidemia. The pharmaceutical compositions of the invention comprise a dsRNA having an antisense strand comprising a region of complementarity which is less than 30 nucleotides in length, generally 19-24 nucleotides in length, and is substantially complementary to at least part of an RNA transcript of the PCSK9 gene, together with a pharmaceutically acceptable carrier.

Accordingly, certain aspects of the invention provide pharmaceutical compositions comprising the dsRNA of the invention together with a pharmaceutically acceptable carrier, methods of using the compositions to inhibit expression of the PCSK9 gene, and methods of using the pharmaceutical compositions to treat diseases that can be modulated by down regulating the expression of PCSK9.

I. Definitions

For convenience, the meaning of certain terms and phrases used in the specification, examples, and appended claims, are provided below. If there is an apparent discrepancy between the usage of a term in other parts of this specification and its definition provided in this section, the definition in this section shall prevail.

"G," "C," "A" and "U" each generally stand for a nucleotide that contains guanine, cytosine, adenine, and uracil as a base, respectively. However, it will be understood that the term "ribonucleotide" or "nucleotide" can also refer to a modified nucleotide, as further detailed below, or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of the invention by a nucleotide containing, for example, inosine. Sequences comprising such replacement moieties are embodiments of the invention.

As used herein, "PCSK9" refers to the proprotein convertase subtilisin kexin 9 gene or protein (also known as FIB, HCHOLA3, NARC-1, NARC1), mRNA sequences to PCSK9 are provided as human: NM_174936; mouse: NM_153565, and rat: NM_199253.

As used herein, "target sequence" refers to a contiguous portion of the nucleotide sequence of an mRNA molecule formed during the transcription of the PCSK9 gene, including mRNA that is a product of RNA processing of a primary transcription product.

As used herein, the term "strand comprising a sequence" refers to an oligonucleotide comprising a chain of nucleotides that is described by the sequence referred to using the standard nucleotide nomenclature.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

This includes base-pairing of the oligonucleotide or polynucleotide comprising the first nucleotide sequence to the oligonucleotide or polynucleotide comprising the second nucleotide sequence over the entire length of the first and second nucleotide sequence. Such sequences can be referred to as "fully complementary" with respect to each other herein. However, where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

"Complementary" sequences, as used herein, may also include, or be formed entirely from, non-Watson-Crick base pairs and/or base pairs formed from non-natural and modified nucleotides, in as far as the above requirements with respect to their ability to hybridize are fulfilled.

The terms "complementary", "fully complementary" and "substantially complementary" herein may be used with respect to the base matching between the sense strand and the antisense strand of a dsRNA, or between the antisense strand of a dsRNA and a target sequence, as will be understood from the context of their use.

As used herein, a polynucleotide which is "substantially complementary to at least part of" a messenger RNA (mRNA) refers to a polynucleotide which is substantially complementary to a contiguous portion of the mRNA of interest (e.g., encoding PCSK9). For example, a polynucleotide is complementary to at least a part of a PCSK9 mRNA if the sequence is substantially complementary to a non-interrupted portion of a mRNA encoding PCSK9.

The term "double-stranded RNA" or "dsRNA", as used herein, refers to a complex of ribonucleic acid molecules, having a duplex structure comprising two anti-parallel and substantially complementary, as defined above, nucleic acid strands. The two strands forming the duplex structure may be different portions of one larger RNA molecule, or they may be separate RNA molecules. Where separate RNA molecules, such dsRNA are often referred to in the literature as siRNA ("short interfering RNA"). Where the two strands are part of one larger molecule, and therefore are connected by an uninterrupted chain, of nucleotides between the 3'-end of one strand and the 5'end of the respective other strand forming the duplex structure, the connecting RNA chain is referred to as a "hairpin loop", "short hairpin RNA" or "shRNA". Where the two strands are connected covalently by means other than an uninterrupted chain of nucleotides between the 3'-end of one strand and the 5'end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. In addition, as used in this specification, "dsRNA" may include chemical modifications to ribonucleotides, including substantial modifications at multiple nucleotides and including all types of modifications disclosed herein or known in the art. Any such modifications, as used in an siRNA type molecule, are encompassed by "dsRNA" for the purposes of this specification and claims.

As used herein, a "nucleotide overhang" refers to the unpaired nucleotide or nucleotides drat protrude from the duplex structure of a dsRNA when a 3'-end of one strand of the dsRNA extends beyond the 5'-end of the other strand, or vice versa. "Blunt" or "blunt end" means that there are no unpaired nucleotides at that end of the dsRNA, i.e., no nucleotide overhang. A "blunt, ended" dsRNA is a dsRNA that is double-stranded over its entire length, i.e., no nucleotide overhang at either end of the molecule. For clarity, chemical caps or non-nucleotide chemical moieties conjugated to the 3' end or 5' end of an siRNA are not considered in determining whether an siRNA has an overhang or is blunt ended.

The term "antisense strand" refers to the strand of a dsRNA which includes a region that is substantially complementary to a target sequence. As used herein, the term "region of complementarity" refers to the region on the antisense strand that is substantially complementary to a sequence, for example a target sequence, as defined herein. Where the region of complementarity is not fully complementary to the target sequence, the mismatches are most tolerated in the terminal regions and, if present, are generally in a terminal region or regions, e.g., within 6, 5, 4, 3, or 2 nucleotides of the 5' and/or 3'terminus.

The term "sense strand," as used herein, refers to the strand of a dsRNA that includes a region that is substantially complementary to a region of the antisense strand.

"Introducing into a cell", when referring to a dsRNA, means facilitating uptake or absorption into the cell, as is understood by those skilled in the art. Absorption or uptake of dsRNA can occur through unaided diffusive or active cellular processes, or by auxiliary agents or devices. The meaning of this term is not limited to cells in vitro; a dsRNA may also be "introduced into a cell", wherein the cell is part of a living organism. In such instance, introduction into the cell will include the delivery to the organism. For example, for in vivo delivery, dsRNA can be injected into a tissue site or administered systemically. In vitro introduction into a cell includes methods known in the art such as electroporation and lipofection.

The terms "silence" and "inhibit the expression of", in as far as they refer to the PCSK9 gene, herein refer to the at least partial, suppression of the expression of the PCSK9 gene, as manifested by a reduction of the amount of mRNA-transcribed from the PCSK9 gene which may be isolated from a first cell or group of cells in which the PCSK9 gene is transcribed and which has or have been treated such that the expression of the PCSK9 gene is inhibited, as compared to a second cell or group of cells substantially identical to the first cell or group of cells but which has or have not been so treated (control cells). The degree of inhibition is usually expressed in terms of $$\frac{(mRNA \text{ in control cells}) - (mRNA \text{ in treated cells})}{(mRNA \text{ in control cells})} \cdot 100\%$$

Alternatively, the degree of inhibition may be given in terms of a reduction of a parameter that is functionally linked to PCSK9 gene transcription, e.g. the amount of protein encoded by the PCSK9 gene which is secreted by a cell, or the number of cells displaying a certain phenotype, e.g. apoptosis. In principle, PCSK9 gene silencing may be determined in any cell expressing the target, either constitutively or by genomic engineering, and by any appropriate assay. However, when a reference is needed in order to determine whether a given dsRNA inhibits the expression of the PCSK9 gene by a certain, degree and therefore is encompassed by the instant invention, the assay provided in the Examples below shall serve as such reference.

For example, in certain instances, expression of the PCSK9 gene is suppressed by at least about 20%, 25%, 35%, or 50% by administration of the double-stranded oligonucleotide of the invention, in some embodiment, the PCSK9 gene is suppressed by at least about 60%, 70%, or 80% by administration of the double-stranded oligonucleotide of the invention. In some embodiments, the PCSK9 gene is suppressed by at least about 85%, 90%, or 95% by administration of the double-stranded oligonucleotide of the invention. Tables 1, 2, provides a wide range of values for inhibition of expression obtained in an in vitro assay using various PCSK9 dsRNA molecules at various concentrations.

As used herein in the context of PCSK9 expression, the terms "treat", "treatment", and the like, refer to relief from or alleviation of pathological processes which, can be mediated by down regulating PCSK9 gene. In the context of the present invention insofar as it relates to any of the other conditions recited herein below (other than pathological processes which can be mediated by down regulating the PCSK9 gene), the terms "treat", "treatment", and the like mean to relieve or alleviate at least one symptom associated with such condition, or to slow or reverse the progression of such condition. For example, in the context of hyperlipidemia, treatment will involve a decrease in serum lipid levels.

As used herein, the phrases "therapeutically effective amount" and "prophylactically effective amount" refer to an amount that provides a therapeutic benefit in the treatment prevention, or management of pathological processes which can be mediated by down regulating the PCSK9 gene on or an overt symptom of pathological processes which can be mediated by down regulating the PCSK9 gene. The specific amount that is therapeutically effective can be readily determined by ordinary medical practitioner, and may vary depending on factors known in the art, such as, e.g. the type of pathological processes which, can be mediated by down regulating the PCSK9 gene, the patient's history and age, the stage of pathological processes which can be mediated by down regulating PCSK9 gene expression, and the administration of other anti-pathological processes which can be mediated by down regulating PCSK9 gene expression.

As used herein, a "pharmaceutical composition" comprises a pharmacologically effective amount of a dsRNA and a pharmaceutically acceptable carrier. As used herein, "pharmacologically effective amount," "therapeutically effective amount" or simply "effective amount" refers to that amount of an RNA effective to produce the intended pharmacological, therapeutic or preventive result. For example, if a given clinical treatment is considered effective when there is at least a 25% reduction in a measurable parameter associated with a disease or disorder, a therapeutically effective amount of a drug for the treatment of that disease or disorder is the amount necessary to effect at least a 25% reduction in that parameter.

The term "pharmaceutically acceptable carrier" refers to a carrier for administration of a therapeutic agent. Such carriers include, but are not limited to, saline, buffered saline, dextrose, water, glycerol, ethanol, and combinations thereof and are described in more detail below. The term specifically excludes cell culture medium.

As used herein, a "transformed cell" is a cell into which a vector has been introduced from which a dsRNA molecule may be expressed.

II. Double-strand Ribonucleic Acid (dsRNA)

In one embodiment, the invention provides double-stranded ribonucleic acid (dsRNA) molecules for inhibiting the expression of the PCSK9 gene in a cell or mammal, wherein the dsRNA comprises an antisense strand comprising a region of complementarity which is complementary to at least a part of an mRNA formed in the expression of the PCSK9 gene, and wherein the region of complementarity is less than 30 nucleotides in length, generally 19-24 nucleotides in length, and wherein said dsRNA, upon contact with a cell expressing said PCSK9 gene, inhibits the expression of said PCSK9 gene by at least 40%. The dsRNA comprises two RNA strands that are sufficiently complementary to hybridize to form a duplex structure. One strand of the dsRNA (the antisense strand) comprises a region of complementarity that is substantially complementary, and generally fully complementary, to a target sequence, derived from the sequence of an mRNA formed during the expression of the PCSK9 gene, the other strand (the sense strand) comprises a region which is complementary to the antisense strand, such that the two strands hybridize and form a duplex structure when combined under suitable conditions. Generally, the duplex structure is between 15 and 30, more generally between 18 and 25, yet more generally between 19 and 24, and most generally between 19 and 21 base pairs in length. Similarly, the region of complementarity to the target sequence is between 15 and 30, more generally between 18 and 25, yet more generally between 19 and 24, and most generally between 19 and 21 nucleotides in length. The dsRNA of the invention may further comprise one or more single-stranded nucleotide overhang(s). The dsRNA can be synthesized by standard methods known in the art as further discussed, below, e.g., by use of an automated DNA synthesizer, such as are commercially available from, for example, Biosearch, Applied Biosystems, Inc. In a preferred embodiment, the PCSK9 gene is the human PCSK9 gene. In specific embodiments, the antisense strand of the dsRNA comprises a strand selected from the sense sequences of Tables 1 and 2, and a second sequence selected from the group consisting of the antisense sequences of Tables 1 and 2. Alternative antisense agents that target, elsewhere in the target sequence provided in Tables 1 and 2, can readily be determined using the target sequence and the flanking PCSK9 sequence.

in further embodiments, the dsRNA comprises at least one nucleotide sequence selected from the groups of sequences provided in Tables 1 and 2 in other embodiments, the dsRNA comprises at least two sequences selected from this group, wherein one of the at least two sequences is complementary to another of the at least two sequences, and one of the at least two sequences is substantially complementary to a sequence of ah mRNA generated in the expression of the PCSK9 gene. Generally, the dsRNA comprises two oligonucleotides, wherein one oligonucleotide is described as the sense strand in Tables 1 and 2 and the second oligonucleotide is described as the antisense strand in Tables 1 and 2

The skilled person is well aware that dsRNAs comprising a duplex structure of between 20 and 23, but specifically 21, base pairs have been hailed as particularly effective in inducing RNA interference (Elbashir et al., EMBO 2001, 20:6877-6888). However, others have found that shorter or longer dsRNAs can be effective as well, in the embodiments described above, by virtue of the nature of the oligonucleotide sequences provided in Tables 1 and 2, the dsRNAs of the invention can comprise at least one strand of a length, of minimally 21 nt. It can be reasonably expected that shorter dsRNAs comprising one of the sequences of Tables 1 and 2 minus only a few nucleotides on one or both, ends may be similarly effective as compared to the dsRNAs described above. Hence, dsRNAs comprising a partial sequence of at least 15, 16, 17, 18, 19, 20, or more contiguous nucleotides from one of the sequences of Tables 1 and 2, and differing in their ability to inhibit the expression of the PCSK9 gene in a FACS assay as described herein below by not more than 5, 10, 15, 20, 25, or 30% inhibition from a dsRNA comprising the full sequence, are contemplated by the invention. Further dsRNAs that cleave within the target sequence provided in Tables 1 and 2 can readily be made using the PCSK9 sequence and the target sequence provided.

In addition, the RNAi agents provided in Tables 1 and 2 identify a site in the PCSK9 mRNA that is susceptible to RNAi based cleavage. As such the present invention further includes RNAi agents that target, within the sequence targeted by one of the agents of the present invention. As used herein a second RNAi agent is said to target within the sequence of a first RNAi agent if the second RNAi agent cleaves the message anywhere within the mRNA that is complementary to the antisense strand of the first RNAi agent. Such a second agent will generally consist of at least 15 contiguous nucleotides from one of the sequences provided in Tables 1 and 2 coupled to additional nucleotide sequences taken from the region contiguous to the selected sequence in the PCSK9 gene. For example, the last 15 nucleotides of SEQ ID NO:1 (minus the added AA sequences) combined with the next 6 nucleotides from the target PCSK9 gene produces a single strand agent of 21 nucleotides that is based on one of the sequences provided in Tables 1 and 2.

The dsRNA of the invention, can contain one or more mismatches to the target sequence. In a preferred embodiment, the dsRNA of the invention contains no more than 3 mismatches. If the antisense strand of the dsRNA contains mismatches to a target sequence, it is preferable that the area of mismatch not be located in the center of the region of complementarity. If the antisense strand of the dsRNA contains mismatches to the target sequence, it is preferable that the mismatch be restricted to 5 nucleotides from either end, for example 5, 4, 3, 2, or 1 nucleotide from either the 5' or 3' end of the region of complementarity. For example, for a 23 nucleotide dsRNA strand which is complementary to a region of the PCSK9 gene, the dsRNA generally does not contain any mismatch within the central 13 nucleotides. The methods described within the invention can be used to determine whether a dsRNA containing a mismatch to a target sequence is effective in inhibiting the expression of the PCSK9 gene. Consideration of the efficacy of dsRNAs with mismatches in inhibiting expression of the PCSK9 gene is important, especially if the particular region of complementarity in the PCSK9 gene is known to have polymorphic sequence variation within the population.

In one embodiment at least one end of the dsRNA has a single-stranded nucleotide overhang of 1 to 4, generally 1 or 2 nucleotides dsRNAs having at least one nucleotide overhang have unexpectedly superior inhibitory properties than their blunt-ended counterparts. Moreover, the present inventors have discovered that the presence of only one nucleotide overhang strengthens the interference activity of the dsRNA, without affecting its overall stability. dsRNA having only one overhang has proven particularly stable and effective in vivo, as well as in a variety of cells, cell culture mediums, blood, and serum. Generally, the single-stranded overhang is located, at the 3'-terminal end of the antisense strand or, alternatively, at the 3'-terminal end of the sense strand. The dsRNA may also have a blunt end, generally located at the 5'-end of the antisense strand. Such dsRNAs have improved stability and inhibitory activity, thus allowing administration at low dosages, i.e., less than 5 mg/kg body weight of the recipient per day. Generally, the antisense strand of the dsRNA has a nucleotide overhang at the 3'-end, and the 5'-end is blunt. In another embodiment, one or more of the nucleotides in the overhang is replaced with a nucleoside thiophosphate.

In yet another embodiment, the dsRNA is chemically modified to enhance stability. The nucleic acids of die invention may be synthesized and/or modified by methods well established in the art, such as those described in "Current protocols in nucleic acid chemistry". Beaucage, S. L. et. al. (Edrs.), John Wiley & Sons, Inc., New York, N.Y., USA, which is hereby incorporated herein by reference. Chemical modifications may include, but are not limited to 2' modifications, modifications at other sites of the sugar or base of an oligonucleotide, introduction of non-natural bases into the olibonucleotide chain, covalent attachment to a ligand or chemical moiety, and replacement of internucleotide phosphate linkages with alternate linkages such as thiophosphates. More than one such modification may be employed.

Chemical linking of the two separate dsRNA strands may be achieved by any of a variety of well-known techniques, for example by introducing covalent, ionic or hydrogen bonds; hydrophobic interactions, van der Waals or stacking interactions; by means of metal-ion coordination, or through, use of purine analogues. Generally, the chemical groups that can be used to modify the dsRNA include, without limitation, methylene blue; bifunctional groups, generally bis-(2-chloroethyl) amine; N-acetyl-N'-(p-glyoxylbenzoyl)cystamine; 4-thiouracil; and psoralen. In one embodiment, the linker is a hexaethylene glycol linker. In this case, the dsRNA are produced by solid phase synthesis and the hexa-ethylene glycol linker is incorporated according to standard methods (e.g., Williams, D. J., and K. B. Hail, *Biochem.* (1996) 35:14665-14670). In a particular embodiment, the 5'-end of the antisense strand and the 3'-end of the sense strand are chemically linked via a hexaethylene glycol linker. In another embodiment, at least one nucleotide of the dsRNA comprises a phosphorothioate or phosphorodithioate groups. The chemical bond at the ends of the dsRNA is generally formed by triple-helix bonds. Tables 1 and 2 provides examples of modified RNAi agents of the invention.

In yet another embodiment, the nucleotides at one or both of the two single strands may be modified to prevent or inhibit the degradation activities of cellular enzymes, such, as, for example, without limitation, certain nucleases. Techniques for inhibiting the degradation activity of cellular enzymes against nucleic acids are known in the art including, but not limited to, 2'-amino modifications, 2'-amino sugar modifications, 2'-F sugar modifications, 2'-F modifications, 2'-alkyl sugar modifications, uncharged backbone modifications, morpholino modifications, 2'-methyl modifications, and phosphoramidate (sec, e.g., Wagner, *Nat. Med.* (1995) 1:1116-8). Thus, at least one 2'-hydroxyl group of the nucleotides on a dsRNA is replaced by a chemical group, generally by a 2'-amino or a 2'-methyl group. Also, at least one nucleotide may be modified to form a locked, nucleotide. Such locked nucleotide contains a methylene bridge that connects the 2'-oxygen of ribose with the 4'-carbon of ribose. Oligonucleotides containing the locked nucleotide are described in Koshkin, A. A., et al., *Tetrahedron* (1998), 54: 3607-3630) and Obika, S. et al. *Tetrahedron Lett*. (1998), 39; 5401-5404). Introduction of a locked nucleotide into an oligonucleotide improves the affinity for complementary sequences and increases the melting temperature by several degrees (Braasch, D. A. and D. R. Corey, *Chem. Biol.* (2001), 8:1-7).

Conjugating a ligand to a dsRNA can enhance its cellular absorption as well as targeting to a particular tissue or uptake by specific types of cells such as liver cells. In certain instances, a hydrophobic ligand is conjugated to the dsRNA to facilitate direct permeation of the cellular membrane and or uptake across the liver cells. Alternatively, the ligand conjugated, to the dsRNA is a substrate for receptor-mediated endocytosis. These approaches have been used to facilitate cell permeation of antisense oligonucleotides as well as dsRNA agents. For example, cholesterol has been conjugated to various antisense oligonucleotides resulting in compounds that are substantially more active compared to their non-conjugated analogs. See M. Manoharan *Antisense & Nucleic Acid Drug Development* 2002, 12, 103. Other lipophilic compounds that have been conjugated to oligonucleotides include 1-pyrene butyric acid, 1,3-bis-O-(hexadecyl)glycerol, and menthol. One example of a ligand for receptor-mediated endocytosis is folic acid. Folic acid enters the cell by folate-receptor-mediated endocytosis. dsRNA compounds bearing folic acid would be efficiently transported into the cell via the folate-receptor-mediated endocytosis. Li and coworkers report that attachment of folic acid to the 3'-terminus of an oligonucleotide resulted in an 8-fold increase in cellular uptake of the oligonucleotide. Li, S.; Deshmukh, H, M.; Huang, L. *Pharm. Res.* 1998, 15, 1540. Other ligands that have been conjugated to oligonucleotides include polyethylene glycols, carbohydrate clusters, cross-linking agents, porphyrin conjugates, delivery peptides and lipids such as cholesterol.

In certain instances, conjugation of a cationic ligand to oligonucleotides results in improved resistance to nucleases. Representative examples of cationic ligands are propylammonium and dimethylpropylammonium. Interestingly, antisense oligonucleotides were reported to retain their high binding affinity to mRNA when the cationic ligand was dispersed throughout the oligonucleotide. See M. Manoharan *Antisense & Nucleic Acid Drug Development* 2002, 12, 103 and references therein.

The ligand-conjugated dsRNA of the invention may be synthesized by the use of a dsRNA that bears a pendant reactive functionality, such as that derived from the attachment of a linking molecule onto the dsRNA. This reactive oligonucleotide may be reacted directly with commercially-available ligands, ligands that are synthesized bearing any of a variety of protecting groups, or ligands that have a linking moiety attached thereto. The methods of the invention facilitate the synthesis of ligand-conjugated dsRNA by the use of, in some preferred embodiments, nucleoside monomers that have been appropriately conjugated with ligands and that may further be attached to a solid-support material. Such ligand-nucleoside conjugates, optionally attached to a solid-support material, are prepared according to some preferred embodiments of the methods of the invention via reaction of a selected serum-binding ligand with a linking moiety located on the 5' position of a nucleoside or oligonucleotide. In certain instances, an dsRNA bearing an aralkyl ligand attached to the 3'-terminus of the dsRNA is prepared by first covalently attaching a monomer building block to a controlled-pore-glass support via a long-chain aminoalkyl group. Then, nucleotides are bonded via standard solid-phase synthesis techniques to the monomer building-block bound to the solid support. The monomer building block may be a nucleoside or other organic compound that is compatible with solid-phase synthesis.

The dsRNA used in the conjugates of the invention may be conveniently and routinely made through the well-known technique of solid-phase synthesis. Equipment for such synthesis is sold by several vendors including, for example, Applied Biosystems (Foster City, Calif.). Any other means for such synthesis known in the art may additionally or alternatively be employed. It is also known to use similar techniques to prepare other oligonucleotides, such as the phosphorothioates and alkylated derivatives.

Teachings regarding the synthesis of particular modified oligonucleotides may be found in the following U.S. Pat. Nos. 5,138,045 and 5,218,105, drawn to polyamine conjugated oligonucleotides: U.S. Pat. No. 5,212,295, drawn to monomers for the preparation of oligonucleotides having chiral phosphorus linkages; U.S. Pat. Nos. 5,378,825 and 5,541,307, drawn to oligonucleotides having modified backbones; U.S. Pat. No. 5,386,023, drawn to backbone-modified oligonucleotides and the preparation thereof through reductive coupling; U.S. Pat. No. 5,457,191, drawn to modified nucleobases based on the 3-deazapurine ring system and methods of synthesis thereof; U.S. Pat. No. 5,459,255, drawn to modified nucleobases based on N-2 substituted purines; U.S. Pat. No. 5,521,302, drawn to processes for preparing oligonucleotides having chiral phosphorus linkages; U.S. Pat. No. 5,539,082, drawn to peptide nucleic acids; U.S. Pat. No. 5,554,746, drawn to oligonucleotides having β-lactam backbones; U.S. Pat. No. 5,571,902, drawn to methods and materials for the synthesis of oligonucleotides; U.S. Pat. No. 5,578,718, drawn to nucleosides having alkylthio groups, wherein such groups may be used as linkers to other moieties attached at any of a variety of positions of the nucleoside; U.S. Pat. Nos. 5,587,361 and 5,599,797, drawn to oligonucleotides having phosphorothioate linkages of high chiral purity; U.S. Pat. No. 5,506,351, drawn to processes for the preparation of 2'-O-alkyl guanosine and related compounds, including 2,6-diaminopurine compounds; U.S. Pat. No. 5,587,469, drawn to oligonucleotides having N-2 substituted purines; U.S. Pat. No. 5,587,470, drawn to oligonucleotides having 3-deazapurines; U.S. Pat. Nos. 5,223,168, and 5,608,046, both drawn to conjugated 4'-desmethyl nucleoside analogs; U.S. Pat. Nos. 5,602,240, and 5,610,289, drawn to backbone-modified oligonucleotide analogs; U.S. Pat. Nos. 6,262,241, and 5,459,255, drawn to, inter alia, methods of synthesizing 2'-fluoro-oligonucleotides.

In the ligand-conjugated dsRNA and ligand-molecule bearing sequence-specific linked nucleosides of the invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already hear a linking moiety, die synthesis of the sequence-specific linked nucleosides is typically completed, and the ligand molecule is then reacted with the linking moiety to form the ligand-conjugated oligonucleotide. Oligonucleotide conjugates bearing a variety of molecules such as steroids, vitamins, lipids aid reporter molecules, has previously been described (see Manoharan et al. PCT Application WO 93/07883). In a preferred embodiment, the oligonucleotides or linked nucleosides of the invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

The incorporation of a 2'-O-methyl 2'-O-ethyl, 2'-O-propyl 2'-O-allyl, 2'-O-aminoalkyl or 2'-deoxy-2'-fluoro group in nucleosides of an oligonucleotide confers enhanced hybridization properties to the oligonucleotide. Further, oligonucleotides containing phosphorothioate backbones have enhanced nuclease stability. Thus, functionalized, linked nucleosides of the invention can be augmented to include either or both a phosphorothioate backbone or a 2'-O-methyl, 2'-O-ethyl, 2'-O-propyl, 2'-O-aminoalkyl, 2'-O-allyl or 2'-deoxy-2'-fluoro group. A summary listing of some of the oligonucleotide modifications known in the art is found at, for example, PCT Publication WO 200370918.

In some embodiments, functionalized nucleoside sequences of the invention possessing an amino group at the 5'-terminus are prepared using a DNA synthesizer, and then reacted with an active ester derivative of a selected ligand. Active ester derivatives are well known to those skilled in the art. Representative active esters include N-hydroxysuccinimide esters, tetrafluorophenolic esters, pentafluorophenolic esters and pentachlorophenolic esters. The reaction of the amino group and the active ester produces an oligonucleotide in which the selected ligand is attached to the 5'-position through a linking group. The amino group at the 5'-terminus can be prepared utilizing a 5'-Amino-Modifier C6 reagent. In one embodiment, ligand molecules may be conjugated to oligonucleotides at the 5'-position by the use of a ligand-nucleoside phosphoramidite wherein the ligand is linked to the 5'-hydroxy group directly or indirectly via a linker. Such ligand-nucleoside phosphoramidites are typically used at the end of an automated synthesis procedure to provide a ligand-conjugated oligonucleotide bearing the ligand at the 5'-terminus.

Examples of modified internucleoside linkages or backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free-acid forms are also included.

Representative United States patents relating to the preparation of the above phosphorus-atom-containing linkages include, but are not limited to, U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; 5,625,050; and 5,697,248, each of which is herein incorporated by reference.

Examples of modified internucleoside linkages or backbones that do not include a phosphorus atom therein (i.e., oligonucleosides) have backbones that are formed by short chain alkyl or cycloalkyl intersugar linkages, mixed heteroatom and alkyl or cycloalkyl intersugar linkages, or one or more short chain heteroatomic or heterocyclic intersugar linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative United States patents relating to the preparation of the above oligonucleosides include, but are not limited to, U.S. Pat. Nos. 5,034,506; 5,166,315; 5,185,444; 5,214,134; 5,216,141; 5,235,033; 5,264,562; 1264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference.

In certain instances, the oligonucleotide may be modified by a non-ligand group. A number of non-ligand molecules have been conjugated to oligonucleotides in order to enhance the activity, cellular distribution or cellular uptake of the oligonucleotide, and procedures for performing such conjugations are available in the scientific literature. Such non-ligand moieties have included lipid moieties, such as cholesterol (Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-S-tritylthiol (Manoharan et al., Ann. N.Y. Acad. Sci., 1992, 660:306; Manoharan et al., Bioorg. Med. Chem. Let, 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett, 1990, 259:327; Svinarchuk et al., Biochimie, 1993, 75:49), a phospholipid, e.g., di-hexadecyl-rac-glycerol or triethylammonium 1,2-di-O-hexadecyl-rac-glycero-3-H-phosphonate (Manoharan et al. Tetrahedron Lett., 1995, 36:3651; Shea et al.,Noel. Acids Res., 1990, 18:3777), a poly amine or a polyethylene glycol chain (Manoharan et al., Nucleosides & Nucleotides, 1995, 14:969), or adamantane acetic acid (Manoharan et al. Tetrahedron Lett., 1995, 36:3651), a palmityl moiety (Mishra et al. Biochim. Biophys. Acta, 1995, 1264:229), or an octadecylamine or hexylamino-carbonyl-oxycholesterol moiety (Crooks et al., J. Pharmacol Exp. Ther., 1996, 277:923). Representative United States patents that teach the preparation of such oligonucleotide conjugates have been listed above. Typical conjugation protocols involve the synthesis of oligonucleotides bearing an aminolinker at one or more positions of the sequence. The amino group is then reacted with the molecule being conjugated using appropriate coupling or activating reagents. The conjugation reaction may be performed either with the oligonucleotide still bound to the solid support or following cleavage of the oligonucleotide in solution phase. Purification of the oligonucleotide conjugate by HPLC typically affords the pure conjugate. The use of a cholesterol conjugate is particularly preferred since such a moiety can increase targeting liver cells, a site of PCSK9 expression.

Vector Encoded RNAi Agents

The dsRNA of the invention can also be expressed from recombinant viral vectors intracellularly in vivo. The recombinant viral vectors of the invention comprise sequences encoding the dsRNA of the invention and any suitable promoter for expressing the dsRNA sequences. Suitable promoters include, for example, the U6 or H1 RNA pol III promoter sequences and the cytomegalovirus promoter. Selection of other suitable promoters is within the skill in the art. The recombinant viral vectors of the invention can also comprise inducible or regulatable promoters for expression of the dsRNA in a particular tissue or in a particular intracellular environment. The use of recombinant viral vectors to deliver dsRNA of the invention to cells in vivo is discussed in more detail below.

dsRNA of the invention can be expressed from a recombinant viral vector either as two separate, complementary RNA molecules, or as a single RNA molecule with two complementary regions.

Any viral vector capable of accepting the coding sequences for the dsRNA molecule(s) to be expressed can be used, for example vectors derived from adenovirus (AV); adeno-associated virus (AAV); retroviruses (e.g., lentiviruses (LV), Rhabdoviruses, murine leukemia virus); herpes virus, and the like. The tropism of viral vectors can be modified by pseudotyping the vectors with envelope proteins or other surface antigens from other viruses, or by substituting different viral capsid proteins, as appropriate.

For example, lentiviral vectors of the invention can be pseudotyped with surface proteins from vesicular stomatitis virus (VSV), rabies, Ebola, Mokola, and the like. AAV vectors of the invention can be made to target different cells by engineering the vectors to express different capsid protein serotypes. For example, an AAV vector expressing a serotype 2 capsid on a serotype 2 genome is called AAV 2/2. This serotype 2 capsid gene in the AAV 2/2 vector can be replaced by a serotype 5 capsid gene to produce an AAV 2/5 vector. Techniques for constructing AAV vectors which express different capsid protein serotypes are within the skill in the art;

see, e.g., Rabinowitz J E et al. (2002), J Virol 76:791-801, the entire disclosure of which is herein incorporated by reference.

Selection of recombinant viral vectors suitable for use in the invention, methods for inserting nucleic acid sequences for expressing the dsRNA into the vector, and methods of delivering the viral vector to the cells of interest are within the skill in the art. See, for example, Dornburg R (1995), Gene Therap. 2: 301-310; Eglitis M A (1988), Biotechniques 6: 608-614; Miller A D (1990), Hum Gene Therap. 1: 5-14; Anderson W F (1998), Nature 392; 25-30; and Rubinson D A et al., Nat. Genet. 33: 401-406, the entire disclosures of which are herein incorporated by reference.

Preferred viral vectors are those derived from AV and AAV. In a particularly preferred embodiment, the dsRNA of the invention is expressed as two separate, complementary single-stranded RNA molecules from a recombinant AAV vector comprising, for example, either the U6 or H1 RNA promoters, or the cytomegalovirus (CMV) promoter.

A suitable AV vector for expressing the dsRNA of the invention, a method for constructing the recombinant AV vector, and a method for delivering the vector into target cells, are described in Xia H et al. (2002), Nat. Biotech, 20; 1006-1010.

Suitable AAV vectors for expressing the dsRNA of the invention, methods for constructing the recombinant AV vector, and methods for delivering the vectors into target cells are described in Samulski R et al. (1987), J. Virol. 61: 3096-3101; Fisher K J et al. (1996), J. Virol, 70: 520-532; Samulski R et al. (1989), J. Virol. 63: 3822-3826; U.S. Pat. Nos. 5,252,479; 5,139,941; International Patent Application No. WO 94/13788; and international Patent Application No. WO 93/24641, the entire disclosures of which are herein incorporated by reference.

III. Pharmaceutical Compositions Comprising dsRNA

In one embodiment, the invention provides pharmaceutical compositions comprising a dsRNA, as described herein, and a pharmaceutically acceptable carrier. The pharmaceutical composition comprising the dsRNA is useful for treating a disease or disorder associated with the expression or activity of the PCSK9 gene, such as pathological processes which, can be mediated by down regulating PCSK9 gene expression, such as hyperlipidemia. Such pharmaceutical compositions are formulated, based on the mode of delivery. One example is compositions that are formulated for delivery to the liver via parenteral delivery.

The pharmaceutical compositions of the invention are administered in dosages sufficient to inhibit expression of the PCSK9 gene. The present inventors have found that, because of their improved efficiency, compositions comprising the dsRNA of the invention can be administered at surprisingly low dosages. A dosage of 5 mg dsRNA per kilogram body weight of recipient per day is sufficient to inhibit or suppress expression of the PCSK9 gene and may be administered systematically to the patient.

In general, a suitable dose of dsRNA will be in the range of 0.01 to 5.0 milligrams per kilogram body weight of the recipient per day, generally in the range of 1 microgram to 1 mg per kilogram body weight per day. The pharmaceutical composition may be administered once daily, or the dsRNA may be administered as two, three, or more sub-closes at appropriate intervals throughout the day or even using continuous infusion or delivery through a controlled release formulation. In that case, the dsRNA contained in each sub-dose must be correspondingly smaller in order to achieve the total daily dosage. The dosage unit can also the compounded for delivery over several days, e.g., using a conventional sustained release formulation which provides sustained release of the dsRNA over a several day period. Sustained release formulations are well known in the art.

The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual dsRNAs encompassed by the invention can be made using conventional methodologies or on the basis of in vivo testing using an appropriate animal model, as described elsewhere herein.

Advances in mouse genetics have generated a number of mouse models for the study of various human diseases, such as pathological processes which can be mediated by down regulating PCSK9 gene expression. Such models are used for in vivo testing of dsRNA, as well as for determining a therapeutically effective dose.

Any method can be used to administer a dsRNA of the present invention to a mammal. For example, administration can be direct; oral; or parenteral (e.g., by subcutaneous, intraventricular, intramuscular, or intraperitoneal injection, or by intravenous drip). Administration can be rapid (e.g., by injection), or can occur over a period of time (e.g., by slow infusion or administration of slow release formulations).

Typically, when treating a mammal with hyperlipidemia, the dsRNA molecules are administered systemically via parental means. For example, dsRNAs, conjugated or unconjugate or formulated with or without liposomes, can be administered intravenously to a patient. For such, a dsRNA molecule can be formulated into compositions such as sterile and non-sterile aqueous solutions, non-aqueous solutions in common solvents such as alcohols, or solutions in liquid or solid oil bases. Such solutions also can contain buffers, diluents, and other suitable additives. For parenteral, intrathecal, or intraventricular administration, a dsRNA molecule can be formulated into compositions such as sterile aqueous solutions, which also can contain buffers, diluents, and other suitable additives (e.g., penetration enhancers, carrier compounds, and other pharmaceutically acceptable carriers).

In addition, dsRNA molecules can be administered to a mammal as biologic or abiologic means as described in, for example, U.S. Pat. No. 6,271,359, Abiologic delivery can be accomplished by a variety of methods including, without limitation, (1) loading liposomes with a dsRNA acid molecule provided herein and (2) complexing a dsRNA molecule with lipids or liposomes to form nucleic acid-lipid or nucleic acid-liposome complexes. The liposome can be composed of cationic aid neutral lipids commonly used to transfect cells in vitro. Cationic lipids can complex (e.g., charge-associate) with negatively charged nucleic acids to form liposomes. Examples of cationic liposomes include, without limitation, lipofectin, lipofectamine, lipofectace, and DOTAP. Procedures for forming liposomes are well, known in the art. Liposome compositions can be formed, for example, from phosphatidylcholine, dimyristoyl phosphatidylcholine, dipalmitoyl phosphatidylcholine, dimyristoyl phosphatidyl glycerol or dioleoyl phosphatidylethanolamine. Numerous lipophilic agents are commercially available, including Lipofectin®, (Invitrogen/Life Technologies, Carlsbad, Calif.) and Effectene™, (Qiagen, Valencia, Calif.). In addition, systemic delivery methods can be optimized using commercially available cationic lipids such as DDAB or DOTAP, each of which can be mixed with a neutral lipid such as DOPE or cholesterol. In some cases, liposomes such as those described by Templeton et al. (Nature Biotechnology, 15: 647-652 (1997)) can be used. In other embodiments, polycations such as polyethyleneimine can be used to achieve delivery in vivo and ex vivo (Boletta et al., J. Am. Soc. Nephrol. 7: 1728 (1996)). Additional information regarding the use of liposomes to deliver nucleic acids can be found in U.S. Pat. No. 6,271,359, PCT Publication WO 96/40964 and Morrissey, D. et al. 2005, Nat Biotechnol. 23(8): 1002-7.

Biologic delivery can be accomplished by a variety of methods including, without limitation, the use of viral vectors. For example, viral vectors (e.g., adenovirus and herpesvirus vectors) can be used to deliver dsRNA molecules to liver cells. Standard molecular biology techniques can be used to introduce one or more of the dsRNAs provided herein into one of the many different viral vectors previously developed to deliver nucleic acid to cells. These resulting viral vectors can be used to deliver the one or more dsRNAs to cells by, for example, infection.

dsRNAs of the present invention can be formulated in a pharmaceutically acceptable carrier or diluent. A "pharmaceutically acceptable carrier" (also referred to herein as an "excipient") is a pharmaceutically acceptable solvent, suspending agent, or any other pharmacologically inert vehicle. Pharmaceutically acceptable carriers can be liquid or solid, and can be selected with the planned manner of administration in mind so as to provide for the desired bulk, consistency, and other pertinent transport and chemical properties. Typical pharmaceutically acceptable carriers include, by way of example and not limitation; water; saline solution; binding agents (e.g., polyvinylpyrrolidone or hydroxypropyl methylcellulose); fillers (e.g., lactose and other sugars, gelatin, or calcium sulfate); lubricants (e.g., starch, polyethylene glycol, or sodium acetate); disintegrates (e.g., starch or sodium starch glycolate); and wetting agents (e.g., sodium, lauryl sulfate).

In addition, dsRNA that target the PCSK9 gene can be formulated into compositions containing the dsRNA admixed, encapsulated, conjugated, or otherwise associated with other molecules, molecular structures, or mixtures of nucleic acids. For example, a composition containing one or more dsRNA agents that target the PCSK9 gene can contain other therapeutic agents such as other lipid lowering agents (e.g., statins).

Methods for Treading Diseases that can be Modulated by Down Regulating the Expression of PCSK9

The methods and compositions described herein can be used to treat diseases and conditions that can be modulated by down regulating PCSK9 gene expression. For example, the compositions described herein can be used to treat hyperlipidemia and other forms of lipid inbalance such as hypercholesterolemia, hypertriglyceridemia and the pathological conditions associated with these disorders such as heart and circulatory diseases.

Methods for Inhibiting Expression of the PCSK9 Gene

In yet another aspect, the invention provides a method for inhibiting the expression of the PCSK9 gene in a mammal. The method comprises administering a composition of the invention to the mammal such that expression of the target PCSK9 gene is silenced. Because of their high specificity, the dsRNAs of the invention specifically target RNAs (primary or processed) of the target PCSK9 gene. Compositions and methods for inhibiting the expression of these PCSK9 genes using dsRNAs can be performed as described elsewhere herein.

In one embodiment, the method comprises administering a composition comprising a dsRNA, wherein the dsRNA comprises a nucleotide sequence which is complementary to at least a part of an RNA transcript of the PCSK9 gene of the mammal to be treated. When the organism to be treated is a mammal such as a human, the composition may be administered by any means known in the art including, but not limited to oral or parenteral routes, including intravenous, intramuscular, subcutaneous, transdermal, airway (aerosol) administration. In preferred embodiments, the compositions are administered by intravenous infusion or injection.

Unless otherwise defined, all technical and scientific terms used herein have the same meaning as commonly understood by one of ordinary skill in the art to which this invention belongs. Although methods and materials similar or equivalent to those described herein can be used in the practice or testing of the invention, suitable methods and materials are described below. Ail publications, patent applications, patents, and other references mentioned herein are incorporated by reference in their entirety. In case of conflict, the present specification, including definitions, will control, in addition, the materials, methods, and examples are illustrative only and not intended to be limiting.

EXAMPLES

Gene Walking of the PCSK9 Gene siRNA design was carried out to identity in two separate selections a) siRNAs targeting PCSK9 human and either mouse or rat mRNA and b) all human reactive siRNAs with predicted specificity to the target gene PCSK9.

mRNA sequences to human, mouse and rat PCSK9 were used: Human sequence NM_174936.2 was used as reference sequence during the complete siRNA selection procedure.

19 mer stretches conserved in human and mouse, and human and rat PCSK9 mRNA sequences were identified in the first step, resulting in the selection of siRNAs crossreactive to human and mouse, and siRNAs crossreactive to human and rat targets SiRNAs specifically targeting human. PCSK9 were identified in a second selection. All potential 19mer sequences of human PCSK9 were extracted and defined as candidate target sequences. Sequences cross-reactive to human, monkey, and those cross-reactive to mouse, rat, human and monkey are all listed in Tables 1 and 2. Chemically modified versions of those sequences and their activity in both in vitro and in vivo assays are also listed in tables 1 and 2 and examples given in FIGS. 2-8.

In order to rank candidate target sequences and their corresponding siRNAs and select appropriate ones, their predicted potential for interacting with irrelevant targets (off-target potential) was taken as a ranking parameter. siRNAs with low off-target potential were defined as preferable and assumed to be more specific in vivo.

For predicting siRNA-specific off-target potential, the following assumptions were made;

1) positions 2 to 9 (counting 5' to 3') of a strand (seed region) may contribute more to off-target potential than rest of sequence (non-seed, and cleavage site region)

2) positions 10 and 11 (counting 5' to 3') of a strand (cleavage site region) may contribute more to off-target potential than non-seed region 3) positions 1 and 19 of each strand are not relevant for off-target interactions 4) an off-target score can be calculated for each gene and each strand, based on complementarity of siRNA strand sequence to the gene's sequence and position of mismatches 5) number of predicted off-targets as well as highest off-target score must be considered for off-target potential 6) off-tar get scores are to be considered more relevant for off-target potential than numbers of off-targets 7) assuming potential abortion of sense strand activity by internal modifications introduced, only off-target potential of antisense strand will be relevant To identify potential off-target genes, 19mer candidate sequences were subjected to a homology search against publically available human mRNA sequences.

The following off-target properties for each 19mer input sequence were extracted for each off-target gene to calculate the off-target score:

Number of mismatches in non-seed region
Number of mismatches in seed region
Number of mismatches in cleavage site region The off-target score was calculated for considering assumption 1 to 3 as follows:

Off-target score=number of seed mismatches*10
number of cleavage site mismatches*1.2
number of non-seed mismatches*1

The most relevant off-target gene for each siRNA corresponding to the input 19mer sequence was defined as the gene with the lowest off-target score. Accordingly, the lowest off-target score was defined as the relevant off-target score for each siRNA.

dsRNA Synthesis
Source of Reagents

Where the source of a reagent is not specifically given herein, such reagent may be obtained from any supplier of reagents for molecular biology at a quality/purity standard for application in molecular biology.

siRNA Synthesis

Single-stranded RNAs were produced by solid phase synthesis on a scale of 1 μmole using an Expedite 8909 synthesizer (Applied Biosystems, Applera Deutschland GmbH, Darmstadt, Germany) and controlled pore glass (CPG, 500 Å, Proligo Biochemie GmbH, Hamburg, Germany) as solid support. RNA and RNA containing 2'-O-methyl nucleotides were generated by solid phase synthesis employing the corresponding phosphoramidites and 2-O-methyl phosphoramidites, respectively (Proligo Biochemie GmbH, Hamburg, Germany). These, building blocks were incorporated at selected sites within the sequence of the oligoribonucleotide chain using standard nucleoside phosphoramidite chemistry such as described in Current, protocols in nucleic acid chemistry, Beaucage, S. L. et al. (Edrs.), John Wiley & Sons, Inc., New York, N.Y., USA, Phosphorothioate linkages were introduced by replacement of the iodine oxidizer solution with a solution of the Beaucage reagent (Chruachem Ltd, Glasgow, UK) in acetonitrile (1%). Further ancillary reagents were obtained from Mallinckrodt Baker (Griesheim, Germany).

Deprotection and purification of the crude oligoribonucleotides by anion exchange HPLC were carried, out according to established procedures. Yields and concentrations were determined by UV absorption of a solution of the respective RNA at a wavelength, of 260 nm using a spectral photometer (DU 640B, Beckman Coulter GmbH, Unterschleißheim, Germany), Double stranded RNA was generated, by mixing an equimolar solution of complementary strands, in annealing buffer (20 mM sodium phosphate, pH 6.8; 100 mM sodium chloride), healed in a water bath at 85-90° C. for 3 minutes and cooled to room temperature over a period of 3-4 hours. The annealed RNA solution was stored at –20° C. until use.

For the synthesis of 3'-cholesterol-conjugated siRNAs (herein referred to as -Chol-3'), an appropriately modified solid support was used for RNA synthesis. The modified solid support was prepared as follows:

Diethyl-2-azabutane-1,4-dicarboxylate AA

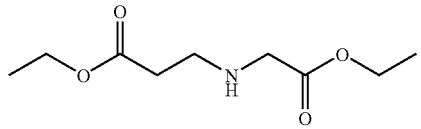

A 4.7 M aqueous solution of sodium hydroxide (50 mL) was added into a stirred, ice-cooled solution of ethyl glycinate hydrochloride (32.19 g, 0.23 mole) in water (50 mL). Then, ethyl acrylate (23.1 g, 0.23 mole) was added and the mixture was stirred at room temperature until completion of the reaction was ascertained by TLC. After 19 h the solution was partitioned with dichloromethane (3×100 mL). The organic layer was dried with anhydrous sodium sulfate, filtered and evaporated. The residue was distilled to afford AA (28.8 g, 61%).

3-{Ethoxycarbonylmethyl-[6-(9H-fluoren-9-yl-methoxycarbonyl-amino)-hexanoyl]-amino}-propionic acid ethyl ester AB

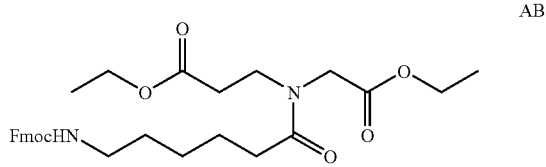

Fmoc-6-amino-hexanoic acid (9.12 g, 25.83 mmol) was dissolved in dichloromethane (50 mL) and cooled with ice. Diisopropylcarbodiimide (3.25 g, 3.99 mL, 25.83 mmol) was added to the solution at 0° C. It was then followed by the addition of Diethyl-azabutane-1,4-dicarboxylate (5 g, 24.6 mmol) and dimethylamino pyridine (0.305 g, 2.5 mmol). The solution was brought to room temperature and stirred further for 6 h. Completion of the reaction was ascertained by TLC. The reaction mixture was concentrated under vacuum and ethyl acetate was added to precipitate diisopropyl urea. The suspension was filtered. The filtrate was washed with 5% aqueous hydrochloric acid, 5% sodium bicarbonate and water. The combined organic layer was dried over sodium sulfate and concentrated to give the crude product which was purified by column chromatography (50% EtOAC/Hexanes) to yield 11.87 g (88%) of AB.

3[(6-Amino-hexanoyl)-ethoxycarbonylmethyl-amino]-propionic acid ethyl ester AC

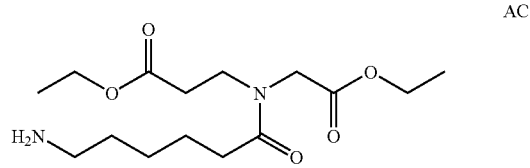

3-{Ethoxycarbonylmethyl-[6-(9H-fluoren-9-ylmethoxy-carbonylamino)-hexanoyl]-amino}-propionic acid ethyl ester AB (11.5 g, 21.3 mmol) was dissolved in 20% piperidine in dimethylformamide at 0° C. The solution was continued stirring for 1 h. The reaction mixture was concentrated under vacuum, water was added to the residue, and the product was extracted with ethyl acetate. The crude product was purified by conversion into its hydrochloride salt.

3-({6-[17-(1,5-Dimethylhexyl)-10,13-dimethyl-2,3,
4,7,8,9,10,11,12,13,14,15,16,17-tetradecahydro-1H-
cyclopenta[a]phenanthren-3-yloxycarbonylamino]-
hexanoyl}ethoxycarbonylmethyl-amino)-propionic
acid ethyl ester AD

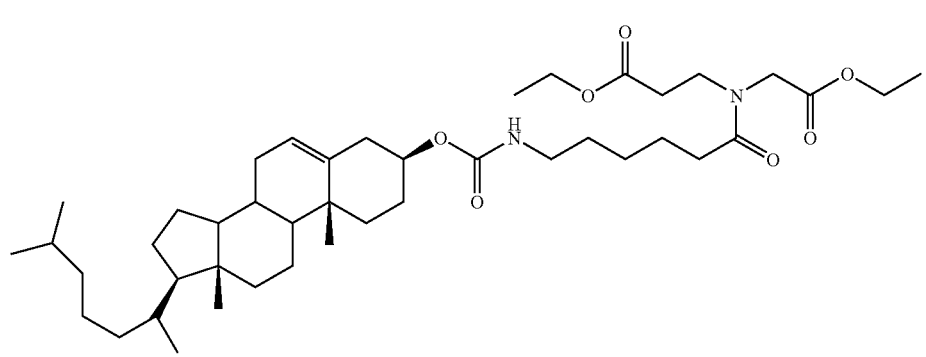

The hydrochloride salt of 3-[(6-Amino-hexanoyl)-ethoxy-carbonylmethyl-amino]-propionic acid ethyl ester AC (4.7 g, 14.8 mmol) was taken up in dichloromethane. The suspension was cooled to 0° C. on ice. To the suspension diisopropylethylamine (3.87 g, 5.2 mL, 30 mmol) was added. To the resulting solution cholesteryl chloroformate (6.675 g, 14.8 mmol) was added. The reaction mixture was stirred overnight. The reaction mixture was diluted with dichloromethane and washed with 10% hydrochloric acid. The product was purified by flash chromatography (10.3 g, 92%).

1-{6-[17-(1,5-Dimethyl-hexyl)-10,13-dimethyl-2,3,
4,7,8,9,10,11,12,13,14,15,16,17-tetradecahydro-1H-
cyclopenta[a] phenanthren-3-yloxycarbonylamino]
hexanoyl}-4-oxo-pyrrolidine-3-carboxylic acid ethyl
ester AE

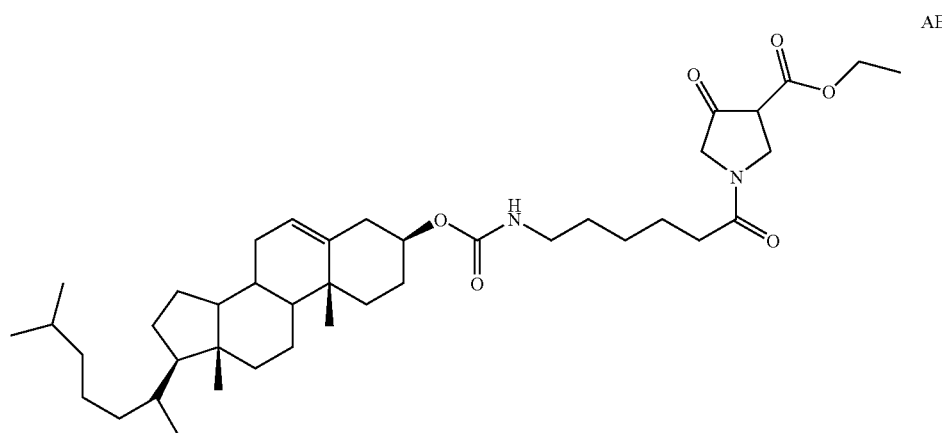

Potassium t-butoxide (1.1 g, 9.8 mmol) was slurried in 30 mL of dry toluene. The mixture was cooled to 0° C. on ice and 5 g (6.6 mmol) of diester AD was added slowly with stirring within 20 mins. The temperature was kept below 5° C. during the addition. The stirring was continued for 30 mins at 0° C. and 1 mL of glacial acetic acid was added, immediately followed by 4 g of NaH$_2$PO$_4$.H$_2$O in 40 mL of water. The resultant mixture was extracted twice with 100 mL of dichloromethane each and the combined organic extracts were washed twice with 10 mL of phosphate buffer each, dried, and evaporated to dryness. The residue was dissolved in 60 mL of toluene, cooled to 0° C. and extracted with three 50 mL portions of cold phi 9.5 carbonate buffer. The aqueous extracts were adjusted to pH 3 with phosphoric acid, and extracted with five 40 mL portions of chloroform which were combined, dried and evaporated to dryness. The residue was purified by column chromatography using 25% ethylacetate/hexane to afford 1.9 g of b-ketoester (39%).

[6-(3-Hydroxy-4-hydroxymethyl-pyrrolidin-1-yl)-6-oxo-hexyl]-carbamic acid 17-(1,5-dimethyl-hexyl)-10,13-dimethyl-2,3,4,7,8,9,10,11,12,13,14,15,16,17-tetradecahydro-1H-cyelopenta[a]phenanthren-3-yl ester AF

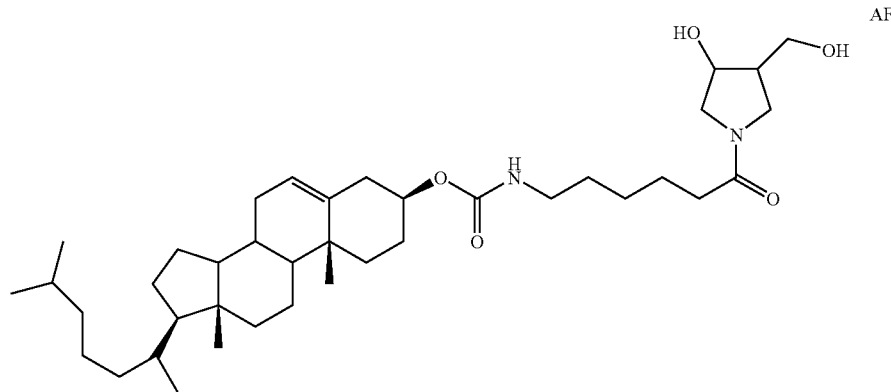

Methanol (2 mL) was added dropwise over a period of 1 h to a refluxing mixture of b-ketoester AE (1.5 g, 2.2 mmol) and sodium borohydride (0.226 g, 6 mmol) in tetrahydrofuran (10 mL). Stirring was continued at reflux temperature for 1 h. After cooling to room temperature, 1 N HCl (12.5 mL) was added, the mixture was extracted with ethylacetate (3×40 mL). The combined ethylacetate layer was dried over anhydrous sodium sulfate and concentrated under vacuum to yield the product which was purified by column chromatography (10% MeOH/CHCl$_3$) (89%).

(6-{3-[Bis-(4-methoxy-phenyl)-phenyl-methoxymethyl]-4-hydroxy-pyrrolidin-1-yl}-6-oxy-hexyl)-carbamic acid 17-(1,5-dimethyl-hexyl)-10,13-dimethyl-2,3,4,7,8,9,10,11,12,13,14,15,16,17-tetradecahydro-1H-cyclopenta[a]phenanthren-3-yl ester AG

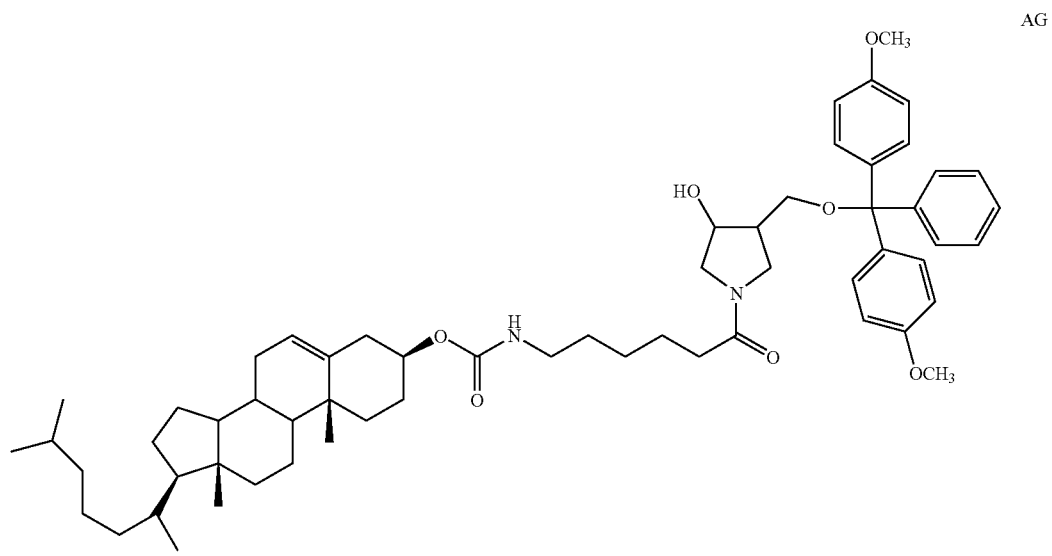

Diol AF (1.25 gm 1.994 mmol) was dried by evaporating with pyridine (2×5 mL) in vacuo. Anhydrous pyridine (10 mL) and 4,4'-dimethoxytritylchloride (0.724 g, 2.13 mmol) were added with stirring. The reaction was earned out at room temperature overnight. The reaction was quenched by the addition of methanol. The reaction mixture was concentrated under vacuum and to the residue dichloromethane (50 mL) was added. The organic layer was washed with 1M aqueous sodium bicarbonate. The organic layer was dried over anhydrous sodium sulfate, filtered and concentrated. The residual pyridine was removed by evaporating with toluene. The crude product was purified by column chromatography (2% MeOH/Chloroform, Rf=0.5 in 5% MeOH/CHCl$_3$) (1.75 g, 95%).

Succinic acid mono-(4-[bis(4-methoxy-phenyl)-phenyl-methoxymethyl]-1-{6-[17-(1,5-dimethyl-hexyl)-10,13-dimethyl 2,3,4,7,8,9,10,11,12,13,14,15,16,17-tetradecahydro-1H cyclopenta[a]phenanthren-3-yloxycarbonylamino]-hexanoyl}-pyrrolidin-3-yl) ester AH

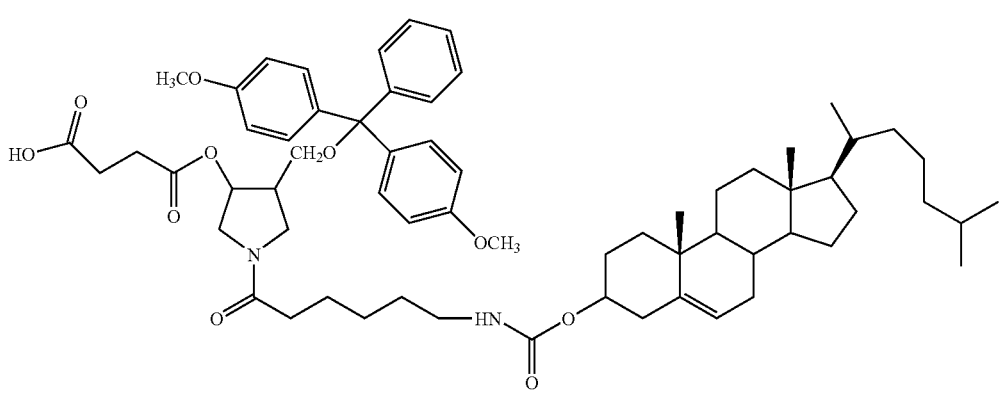

AH

Compound AG (1.0 g, 1.05 mmol) was mixed with succinic anhydride (0.150 g, 1.5 mmol) and DMAP (0.073 g, 0.6 mmol) and dried in a vacuum at 40° C. overnight. The mixture was dissolved in anhydrous dichloroethane (3 mL), triethylamine (0.318 g, 0.440 mL, 3.15 mmol) was added and the solution was stirred at room temperature under argon atmosphere for 16 h. It was then diluted with dichloromethane (40 mL) and washed with ice cold aqueous citric acid (5 wt %, 30 mL) and water (2×20 mL). The organic phase was dried over anhydrous sodium sulfate and concentrated to dryness. The residue was used as such for the next step.

Cholesterol derivatised CPG AI

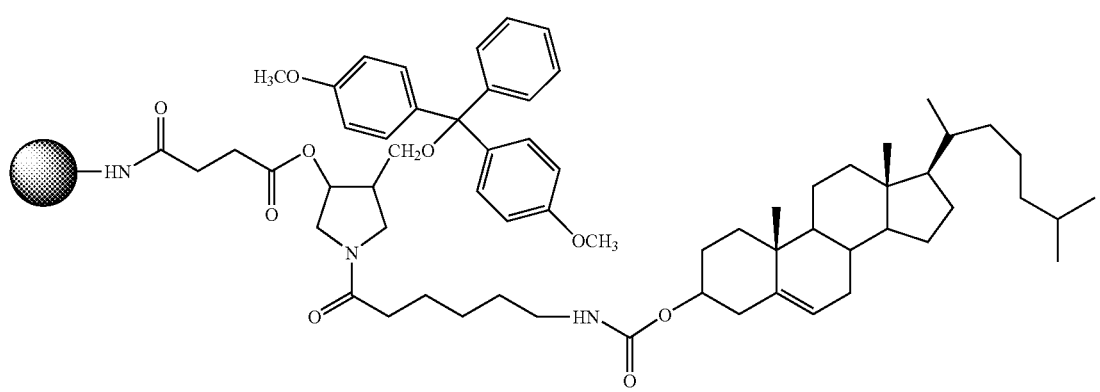

AI

Succinate AH (0.254 g, 0.242 mmol) was dissolved in a mixture of dichloromethane/acetonitrile (3:2, 3 mL). To that solution DMA (0.0296 g, 0.242 mmol) in acetonitrile (1.25 mL), 2,2'-Dithio-bis(5-nitropyridine) (0.075 g, 0.242 mmol) in acetonitrile/dichloroethane. (3:1, 1.25 mL) were added successively. To the resulting solution triphenylphosphine (0.064 g, 0.242 mmol) in acetonitrile (0.6 ml) was added. The reaction mixture turned bright orange in color. The solution, was agitated briefly using a wrist-action shaker (5 mins). Long chain alkyl amine-CPG (LCAA-CPG) (1.5 g, 61 mM) was added. The suspension was agitated for 2 h. The CPG was filtered through a sintered funnel and washed with acetonitrile, dichloromethane and ether successively. Unreacted amino groups were masked using acetic anhydride/pyridine. The achieved loading of die CPG was measured by taking UV measurement (37 mM/g).

The synthesis of siRNAs bearing a 5'-12-dodecanoic acid bisdecylamide group (herein referred to as "5-C32-") or a 5'-cholesteryl derivative group (herein referred to as "5'-Chol-".) was performed as described in WO 2004/065601, except that, for the cholesteryl derivative, the oxidation step was performed using the Beaucage reagent in order to introduce a phosphorothioate linkage at the 5'-end of the nucleic acid oligomer.

Nucleic acid sequences are represented below using standard nomenclature, and specifically the abbreviations of Table 1-2.

TABLE 1-2

Abbreviations of nucleotide monomers used in nucleic acid sequence representation. It will be understood that these monomers, when present in an oligonucleotide, are mutually linked by 5'-3'-phosphodiester bonds.

| Abbreviation[a] | Nucleotide(s) |
| --- | --- |
| A, a | 2'-deoxy-adenosine-5'-phosphate, adenosine-5'-phosphate |
| C, c | 2'-deoxy-cytidine-5'-phosphate, cytidine-5'-phosphate |
| G, g | 2'-deoxy-guanosine-5'-phosphate, guanosine-5'-phosphate |
| T, t | 2'-deoxy-thymidine-5'-phosphate, thymidine-5'-phosphate |
| U, u | 2'-deoxy-uridine-5'-phosphate, uridine-5'-phosphate |
| N, n | any 2'-deoxy-nucleotide/nucleotide (G, A, C, or T, g, a, c or u) |
| Am | 2'-O-methyladenosine-5'-phosphate |
| Cm | 2'-O-methylcytidine-5'-phosphate |
| Gm | 2'-O-methylguanosine-5'-phosphate |
| Tm | 2'-O-methyl-thymidine-5'-phosphate |
| Um | 2'-O-methyluridine-5'-phosphate |
| Af | 2'-fluoro-2'-deoxy-adenosine-5'-phosphate |
| Cf | 2'-fluoro-2'-deoxy-cytidine-5'-phosphate |
| Gf | 2'-fluoro-2'-deoxy-guanosine-5'-phosphate |
| Tf | 2'-fluoro-2'-deoxy-thymidine-5'-phosphate |
| Uf | 2'-fluoro-2'-deoxy-uridine-5'-phosphate |
| <u>A</u>, <u>C</u>, <u>G</u>, <u>T</u>, <u>U</u>, <u>a</u>, <u>c</u>, <u>g</u>, <u>t</u>, <u>u</u> | underlined: nucleoside-5'-phosphorothioate |
| <u>am</u>, <u>cm</u>, <u>gm</u>, <u>tm</u>, <u>um</u> | underlined: 2-O-methyl-nucleoside-5'-phosphorothioate |

[a]capital letters represeat 2'-deoxyribonucleotides (DNA), lower case letters represent ribonucleotides (RNA)

PCSK9 siRNA Screening in HuH7, HepG2, Hela and Primary Monkey Hepatocytes Discovers Highly Active Sequences HuH-7 cells were obtained from JCRB Cell Bank (Japanese Collection of Research Bioresources) (Shinjuku, Japan, cat. No.: JCRB0403) Cells were cultured in Dulbecco's MEM (Biochrom AG, Berlin, Germany, eat. No. F0435) supplemented to contain 10% fetal calf serum (FCS) (Biochrom AG, Berlin, Germany, cat. No. S0115), Penicillin 100 U/ml, Streptomycin 100 µg/ml (Biochrom AG, Berlin, Germany, cat. No, A2213) and 2 mM L-Glutamin (Biochrom AG, Berlin, Germany, cat. No K0282) at 37° C. in an atmosphere with 5% $CO_2$ in a humidified incubator (Heraeus HERAcell, Kendro Laboratory Products, Langenselbold, Germany). HepG2 and Hela cells were obtained from American Type Culture Collection (Rockville, Md., cat. No, HB-8065) and cultured in MEM (Gibco Invitrogen, Karlsruhe, Germany, eat. No, 21090-022) supplemented to contain 10% fetal calf serum (FCS) (Biochrom AG, Berlin, Germany, cat. No. S0115), Penicillin 100 U/ml, Streptomycin 100 µg/ml (Biochrom AG, Berlin, Germany, cat. No. A2213), 1× Non Essential Amino Acids (Biochrom AG, Berlin, Germany, cat. No. K-0293), and 1 mM Sodium Pyruvate (Biochrom AG, Berlin, Germany, cat. No. L-0473) at 37° C. in an atmosphere with 5% $CO_2$ in a humidified incubator (Heraeus HERAcell, Kendro Laboratory Products, Langenselbold, Germany).

For transfection with siRNA, HuH7, HepG2, or Hela cells were seeded at a density of $2.0 \times 10^4$ cells/well in 96-well plates and transfected directly. Transfection of siRNA (30 nM for single dose screen) was carried out with lipofectamine 2000 (Invitrogen GmbH, Karlsruhe, Germany, cat. No. 11668-019) as described by the manufacturer.

24 hours after transfection HuH7 and HepG2 cells were lysed and PCSK9 mRNA levels were quantified with the Quantigene Explore Kit (Genosprectra, Dumbarton Circle Fremont, USA, cat. No. QG-000-02) according to the protocol. PCSK9 mRNA levels were normalized to GAP-DH mRNA. For each siRNA eight individual datapoints were collected, siRNA duplexes unrelated to PCSK9 gene were used as control. The activity of a given. PCSK9 specific siRNA duplex was expressed as percent PCSK9 mRNA concentration in treated cells relative to PCSK9 mRNA concentration in cells treated with the control siRNA duplex.

Primary cynomolgus monkey hepatocytes (cryopreserved) were obtained from In vitro Technologies, Inc. (Baltimore, Md., USA, cat No M00305) and cultured in In VitroGRO CP Medium (cat No Z99029) at 37° C. in an atmosphere with 5% $CO_2$ in a humidified incubator.

For transfection with siRNA, primary cynomolgus monkey cells were seeded on Collagen coated plates (Fisher Scientific, cat. No. 08-774-5) at a density of $3.5 \times 10^4$ cells/well in 96-well plates and transfected directly. Transfection of siRNA (eight 2-fold dilution series starting from 30 nM) in duplicates was carried out with lipofectamine 2000 (Invitrogen GmbH, Karlsruhe, Germany, cat. No. 11668-019) as described by the manufacturer.

16 hours after transaction medium was changed to fresh In VitroGRO CP Medium with Torpedo Antibiotic Mix (In vitro Technologies, Inc, cat. No Z99000) added.

24 hours alter medium change primary cynomolgus monkey cells were lysed and PCSK9 mRNA levels were quantified with the Quantigene Explore Kit (Genosprectra, Dumbarton Circle Fremont, USA, cat. No, QG-000-02) according to the protocol. PCSK9 mRNA levels were normalized to GAPDH mRNA. Normalized PCSK9/GAPDH ratios were then compared to PCSK9/GAPDH ratio of lipofectamine 2000 only control.

Tables 1-2 (and FIG. 6) summarize the results and provides examples of in vitro screens in different cell lines at different doses. Silencing of PCSK9 transcript was expressed as percentage of remaining transcript at a given dose. Highly active sequences are those with less than 70% transcript remaining post treatment with a given siRNA at a dose less than or equal to 100 nm. Very active sequences are those that have less than 60% of transcript remaining after treatment with a dose less than or equal to 100 nM. Active sequences are those that have less than 85% transcript remaining after treatment with a high dose (100 nM). Examples of active siRNA's were also screened in vivo in mouse in lipidoid formulations as described below. Active sequences in vitro were also generally active in vivo (See figure FIG. 6 example).

In vivo Efficacy Screen of PCSK9 siRNAs

Formulation Procedure

Figure 1:
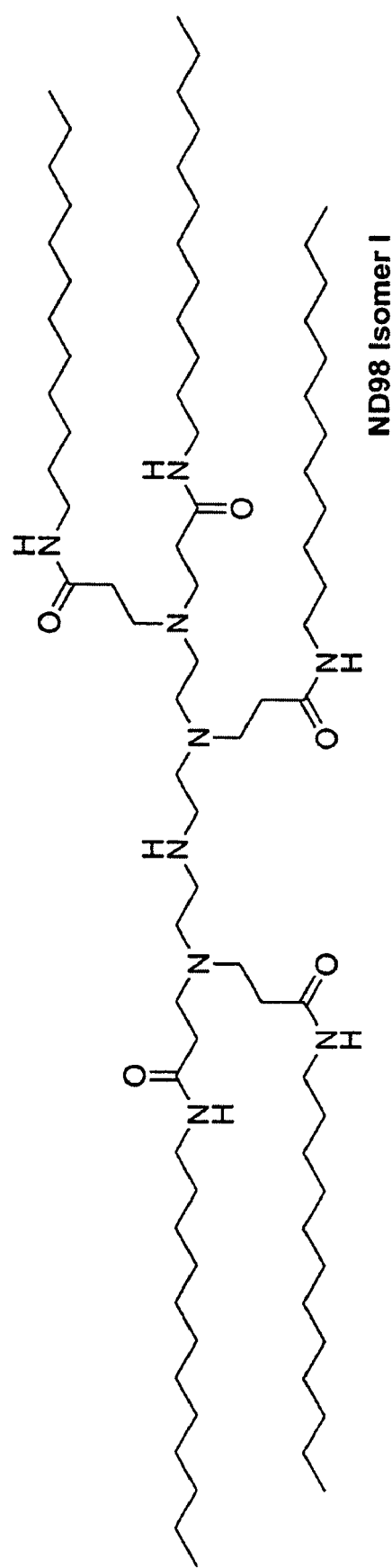
FIG. 1 shows the structure of the ND-98 lipid.
Figure 2:
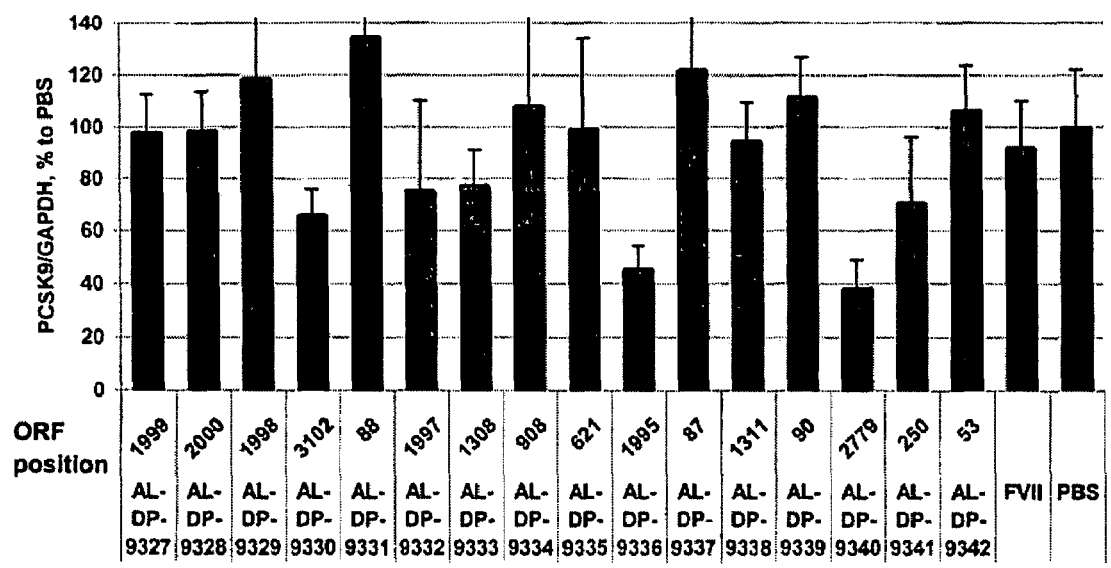
FIG. 2 shows the results of the in vivo screen of 16 mouse specific (AL-DP-9327 through AL-DP-9342) PCSK9 siRNAs directed against different ORF regions of PCSK9 mRNA (having the first nucleotide corresponding to the ORF position indicated on the graph) in C57/BL6 mice (5 animals/group). The ratio of PCSK9 mRNA to GAPDH mRNA in liver lysates was averaged over each treatment group and compared to a control group treated with PBS or a control group treated with an unrelated siRNA (blood coagulation factor VII).
Figure 3:
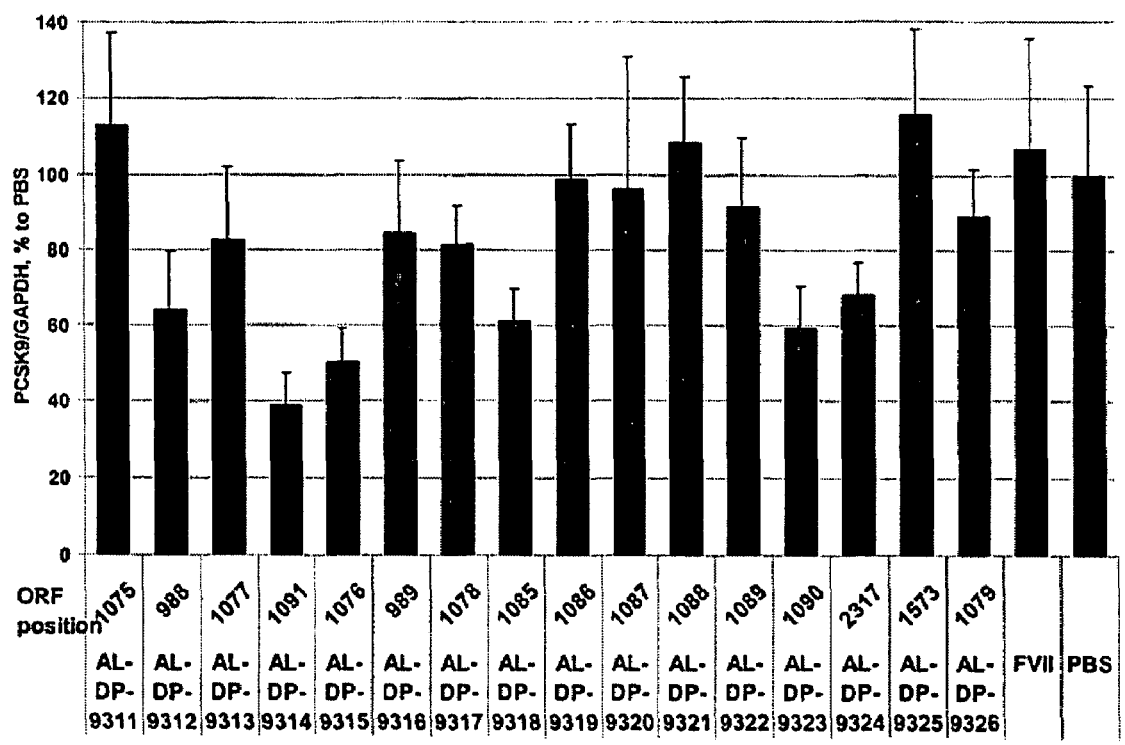
FIG. 3 shows the results of the in vim screen of 16 human/mouse/rat crossreactive (AL-DP-9311 through AL-DP-9326) PCSK9 siRNAs directed against different ORF regions of PCSK9 mRNA (having the first nucleotide corresponding to the ORF position indicated on the graph) in C57/BL6 mice (5 animals/group). The ratio of PCSK9 mRNA, to GAPDH mRNA in liver lysates was averaged over each treatment group and compared to a control group treated with PBS or a control group treated with an unrelated siRNA (blood coagulation factor VII).

The lipidoid LNP-01 4HCl (MW 1487) (FIG. 1), Cholesterol (Sigma-Aldrich), and PEG-Ceramide C16 (Avanti Polar Lipids) were used to prepare lipid-siRNA nanoparticles. Stock solutions of each in ethanol were prepared; LNP-01, 133 mg/mL; Cholesterol, 25 mg/mL, PEG-Ceramide C16, 100 mg/mL. LNP-01, Cholesterol, and PEG-Ceramide C16 stock solutions were then combined in a 42:48:10 molar ratio. Combined lipid solution was mixed rapidly with aqueous siRNA (in sodium acetate pH 5) such that the final ethanol concentration was 35-45% and the final sodium acetate concentration was 100-300 mM. Lipid-siRNA nanoparticles formed spontaneously upon mixing. Depending on the desired particle size distribution, the resultant nanoparticle mixture was in some cases extruded through a polycarbonate membrane (100 nm cut-off) using a thermobarrel extruder (Lipex Extruder, Northern Lipids, Inc). In other cases, the extrusion step was omitted. Ethanol removal and simultaneous buffer exchange was accomplished by either dialysis or tangential flow filtration. Buffer was exchanged to phosphate buffered saline (PBS) pH 7.2.

Characterization of Formulations

Formulations prepared by either the standard or extrusion-free method are characterized in a similar manner Formulations are first characterized by visual inspection. They should be whitish translucent solutions free from aggregates or sediment. Particle size and particle size distribution of lipid-nanoparticles are measured by dynamic light scattering using a Malvern Zetasizer Nano ZS (Malvern, USA). Particles should be 20-300 nm, and ideally; 40-100 nm in size. The particle size distribution should be unimodal. The total siRNA concentration in the formulation, as well as the entrapped fraction, is estimated using a dye exclusion assay. A sample of the formulated siRNA is incubated with the RNA-binding dye Ribogreen (Molecular Probes) in the presence or absence of a formulation disrupting surfactant, 0.5% Triton-X100. The total siRNA in the formulation is determined by the signal from the sample containing the surfactant, relative to a standard curve. The entrapped traction is determined by subtracting the "free" siRNA content (as measured by the signal in the absence of surfactant) from the total siRNA content. Percent entrapped siRNA is typically >85%.

Bolus Dosing

Bolus dosing of formulated siRNAs in C57/BL6 mice (5/group, 8-10 weeks old, Charles River Laboratories, MA) was performed by tail vein injection using a 27G needle. SiRNAs were formulated in LNP-01 (and then dialyzed against PBS) at 0.5 mg/ml concentration allowing the delivery of the 5 mg/kg dose in 10 µl/g body weight. Mice were kept under an infrared lamp for approximately 3 min prior to dosing to ease injection.

48 hour post dosing mice were sacrificed by $CO_2$ asphyxiation. 0.2 ml blood was collected by retro-orbital bleeding and the liver was harvested and frozen in liquid nitrogen. Serum and livers were stored at −80° C.

Frozen livers were grinded using 6850 Freezer/Mill Cryogenic Grinder (SPEX CentriPrep, Inc) and powders stored at −80° C. until analysis.

PCSK9 mRNA levels were detected using the branched-DNA technology based kit from QuantiGene Reagent System (Genospectra) according to the protocol. 10-20 mg of frozen liver powders was lysed in 600 ul of 0.16 ug/ml Proteinase K (Epicentre, #MPRK092) in Tissue and Cell Lysis Solution (Epicentre, #MTC096H) at 65° C. for 3 hours. Then 10 ul of the lysates were added to 90 ul of Lysis Working Reagent (1 volume of stock Lysis Mixture in two volumes of water) and incubated at 52° C. overnight on Genospectra capture plates with probe sets specific to mouse PCSK9 and mouse GAPDH or cyclophilin B. Nucleic acid sequences for Capture Extender (CE), Label Extender (LE) and blocking (BL) probes were selected from the nucleic-acid sequences of PCSK9, GAPDH and cyclophilin B with the help of the QuantiGene ProbeDesigner Software 2.0 (Genospectra, Fremont, Calif., USA, cat No. QG-Q002-G02). Chemo luminescence was read on a Victor2-Light (Perkin Elmer) as Relative light units. The ratio of PCSK9 mRNA to GAPDH or cyclophilin B mRNA in liver lysates was averaged over each treatment group and compared to a control group treated with PBS or a control group treated with an unrelated siRNA (blood coagulation factor VII).

Total serum cholesterol in mouse serum was measured using the StanBio Cholesterol LiquiColor kit (StanBio Laboratory, Boerne, Tex., USA) according to manufacturer's instructions. Measurements were taken on a Victor2 1420 Multilabel Counter (Perkin Elmer) at 495 nm.

EXAMPLES

32 PCSK9 siRNAs formulated in LNP-01 liposomes were tested in vivo in a mouse model. The experiment was performed at 5 mg/kg siRNA dose and at least 10 PCSK9 siRNAs showed more than 40% PCSK9 mRNA knock down compared to a control group treated with PBS, while control group treated with an unrelated siRNA (blood coagulation factor VII) had no effect (FIGS. 2-5). Silencing of PCSK9 transcript also coorelated with a lowering of cholesterol in these animals (FIGS. 4-5). In addition there was a strong coorelation between those molecules that were active in vitro and those active in vivo (FIG. 6). Sequences containing different chemical modifications were also screened in vitro (Tables 1 and 2) and in vivo. As an example, less modified sequences 9314 and 9318, and a more modified versions of that sequence 9314-(10792, 10793, and 10796); 9318-(10794, 10795, 10797) were tested both in vitro (In primary monkey hepatocytes) or in vivo (9314 and 10792) formulated in LNP-01. FIG. 7 (also see Tables 1 and 2) shows that the parent molecules 9314 and 9318 and the modified versions are all active in vitro. FIG. 8 as an example shows that both the parent 9314 and the more highly modified 10792 sequences are active in vivo displaying 50-60% silencing of endogenous PCSK9 in mice. FIG. 9 further exemplifies that activity of other chemically modified versions of the parents 9314 and 10792.

dsRNA Expression Vectors

In another aspect of the invention, PCSK9 specific dsRNA molecules that modulate PCSK9 gene expression activity are expressed from transcription units inserted into DNA or RNA vectors (see, e.g., Couture, A. et al., *TIG*. (1996), 12:5-10; Skillern, A., et al., International PCT Publication No. WO 00/22113, Conrad, International PCT Publication No. WO 00/22114, and Conrad, U.S. Pat. No. 6,054,299). These transgenes can be introduced as a linear construct a circular plasmid, or a viral vector, which can be incorporated and inherited as a transgene integrated into the host genome. The transgene can also be constructed to permit it to be inherited as an extrachromosomal plasmid (Gassmann, et al., *Proc. Natl. Acad. Sci. USA* (1995) 92:1292).

The individual strands of a dsRNA can be transcribed by promoters on two separate expression vectors and co-transfected into a target cell. Alternatively each individual strand of the dsRNA can be transcribed by promoters both of which are located on the same expression plasmid. In a preferred embodiment, a dsRNA is expressed as an inverted repeat joined by a linker polynucleotide sequence such that the dsRNA has a stem and loop structure.

The recombinant dsRNA expression vectors are generally DNA plasmids or viral vectors. dsRNA expressing viral vectors can be constructed based on, but not limited to, adeno-associated virus (for a review, see Muzyczka, et al., *Curr. Topics Micro. Immunol.* (1992) 158:97-129)); adenovirus (see, for example, Berkner, et al., BioTechniques (1998) 6:616), Rosenfeld et al. (1991, Science 252:431-434), and Rosenfeld et al. (1992), *Cell* 68:143-155)); or alphavirus as well as others blown in the art. Retroviruses have been used to introduce a variety of genes into many different cell types, including epithelial cells, in vitro and/or in vivo (see, e.g., Eglitis, et al., Science (1985) 230:1395-1398; Danes and Mulligan, Proc. Natl. Acad. Sci. USA (1998) 85:6460-6464; Wilson et al., 1988, Proc. Natl. Acad. Sci. USA 85:3014-3018; Armentano et al., 1990, Proc. Natl. Acad. Sci. USA. 87:61416145; Huber et al., 1991, Proc. Natl. Acad. Sci. USA 88:8039-8043; Ferry et al., 1991, Proc. Natl. Acad. Sci. USA 88:8377-8381; Chowdhury et al., 1991, Science 254:1802-1805; van Beuscechem, et al. 1992, Proc. Natl. Acad. Sci. USA 89:7640-19; Kay et al., 1992, Human Gene Therapy 3:641-647; Dai et al., 1992, Proc. Natl. Acad. Sci. USA 89:10892-10895; Hwu et al., 1993, J. Immunol. 150:4104-4115; U.S. Pat. No. 4,868,116; U.S. Pat. No. 4,980,286; PCT Application WO 89/07136; PCT Application. WO 89/02468; PCT Application WO 89/05345; and PCT Application WO 92/07573). Recombinant retroviral vectors capable of transducing and expressing genes inserted into the genome of a cell can be produced by transfecting the recombinant retroviral genome into suitable packaging cell lines such as PA317 and Psi-CRIP (Cornette et al., 1991, Human Gene Therapy 2:5-10; Cone et al., 1984, Proc. Natl. Acad. Sci, USA 81:6349). Recombinant adenoviral vectors can be used to infect a wide variety of cells and tissues in susceptible hosts (e.g., rat, hamster, dog, and chimpanzee) (Hsu et al., 1992. J. Infectious Disease, 166:769), and also have the advantage of not requiring mitotically active cells for infection.

The promoter driving dsRNA expression in either a DNA plasmid or viral vector of the invention may be a eukaryotic RNA polymerase I (e.g. liposomal RNA promoter), RNA polymerase II (e.g. CMV early promoter or actin promoter or U1 snRNA promoter) or generally RNA polymerase III promoter (e.g. U6 snRNA or 7SK RNA promoter) or a prokaryotic promoter, for example the T7 promoter, provided the expression plasmid also encodes T7 RNA polymerase required for transcription from a T7 promoter. The promoter can also direct transgene expression, to the pancreas (see, e.g. the insulin regulatory sequence for pancreas (Bucchini et al., 1986, Proc. Natl. Acad. Sci. USA 83:2511-2515)).

In addition, expression of the transgene can be precisely regulated, for example, by using an inducible regulatory sequence and expression systems such as a regulatory sequence that is sensitive to certain physiological regulators, e.g., circulating glucose levels, or hormones (Docherty et al., 1994, FASEB J. 8:20-24). Such inducible expression systems, suitable for the control of transgene expression in cells or in mammals include regulation by ecdysone, by estrogen, progesterone, tetracycline, chemical, inducers of dimerization, and isopropyl-beta-D1-thiogalactopyranoside (EPTG). A person skilled in the art would be able to choose the appropriate regulatory/promoter sequence based on the intended use of the dsRNA transgene.

Generally, recombinant vectors capable of expressing dsRNA molecules are delivered as described below, and persist in target cells. Alternatively, viral vectors can be used that provide for transient expression of dsRNA molecules. Such vectors can be repeatedly administered as necessary. Once expressed, the dsRNAs bind to target RNA and modulate its function or expression. Delivery of dsRNA expressing vectors can be systemic, such as by intravenous or intramuscular administration, by administration to target cells ex-planted from the patient followed by reintroduction into the patient, or by any other means that allows for introduction into a desired target cell.

dsRNA expression DNA plasmids are typically transfected into target cells as a complex with cationic lipid carriers (e.g. Oligofectamine) or non-cationic lipid-based carriers (e.g. Transit-TKO™). Multiple lipid transfections for dsRNA-mediated knockdowns targeting different regions of a single PCSK9 gene or multiple PCSK9 genes over a period of a week or more are also contemplated by the invention. Successful introduction of the vectors of the invention into host cells can be monitored using various known methods. For example, transient transfection. can be signaled with, a reporter, such as a fluorescent marker, such as Green Fluorescent Protein (GFP). Stable transfection. of ex vivo cells can be ensured using markers that provide the transfected cell with resistance to specific environmental factors (e.g., antibiotics and drugs), such as hygromycin B resistance.

The PCSK9 specific dsRNA molecules can also be inserted into vectors and used as gene therapy vectors for human patients. Gene therapy vectors can be delivered to a subject by, for example, intravenous injection, local administration (see U.S. Pat. No. 5,328,470) or by stereotactic injection (see e.g., Chen et al. (1994) Proc. Natl. Acad. Sci. USA 91:3054-3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

Those skilled in the art are familiar with methods and compositions in addition to those specifically set out in the instant disclosure which will allow them to practice this invention to the full scope of the claims hereinafter appended.

| position in human access. # NM_174936[1] | Sense strand sequence (5'-3')[1] | SEQ ID NO: | Antisense-strand sequence (5'-3') | SEQ ID NO: | Duplex name | 100 nM/ HepG 2 | 30 nM/ HepG 2 | 3 nM/ HepG 2 | 30 nM/ Hela | IC50 in HepG 2 [nM] | IC50 in Cynomolgous monkey Hepatacyte [nM]s |
|---|---|---|---|---|---|---|---|---|---|---|---|
| 2-20 | AGCGACGUCGAGGCGCUCATT | 1 | UGAGCGCCUCGACGCCGCUTT | 2 | AD-15220 | | | | 35 | | |
| 15-33 | CGCUCAUGGUUGCAGGCGGTT | 3 | CCGCCUGCAACCAUGAGCGTT | 4 | AD-15275 | | | | 56 | | |
| 16-34 | GCUCAUGGUUGCAGGCGGGTT | 5 | CCCGCCUGCAACCAUGAGCTT | 6 | AD-15301 | | | | 70 | | |
| 30-48 | GCGGGCGCCGCCGUUCAGUTT | 7 | ACUGAACGGCGGCGCCCGCTT | 8 | AD-15276 | | | | 42 | | |
| 31-49 | CGGGCGCCGCCGUUCAGUUTT | 9 | AACUGAACGGCGGCGCCCGTT | 10 | AD-15302 | | | | 32 | | |
| 32-50 | GGGCGCCGCCGUUCAGUUCTT | 11 | GAACUGAACGGCGGCGCCCTT | 12 | AD-15303 | | | | 37 | | |
| 40-58 | CCGUUCAGUUCGCAGGGUCUGTT | 13 | CAGACCCUGAACUGAACGGTT | 14 | AD-15221 | | | | 30 | | |
| 43-61 | UUCAGUUCAGGGUCUGAGCTT | 15 | GCUCAGACCCUGAACUGAATT | 16 | AD-15413 | | | | 61 | | |
| 82-100 | GUGAGACGGGCUCGGGCGGTT | 17 | CCGCCCGAGCCAGUCUCACTT | 18 | AD-15304 | | | | 70 | | |
| 100-118 | GGCCGGGACGCGGUCGUUGCTT | 19 | GCAACGACGCGUCCCGGCCTT | 20 | AD-15305 | | | | 36 | | |
| 101-119 | GCCGGGACGCGGUCGUUGCATT | 21 | UGCAACGACGCGUCCCGGCTT | 22 | AD-15306 | | | | 20 | | |
| 102-120 | CCGGGACGCGGUCGUUGCAGTT | 23 | CUGCAACGACGCGUCCCGGTT | 24 | AD-15307 | | | | 38 | | |
| 105-123 | GGACGCGGUCGUUGCAGCAGTT | 25 | CUGCUGCAACGACGCCGUCCTT | 26 | AD- | | | | 50 | | |
| 135-153 | CCCCAGCCAGGAUUCCGCGTsT | 27 | CGCGGAAUCCUGGCUGGGATsT | 28 | AD-9526 | 74 | 89 | | | | |

-continued

| position in human access. # NM_174936 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 135-153 | ucctAGccAGGAuuccGcGTsT | 29 | CGCGGAAUCCUGGCUGGGATsT | 30 | AD-9652 | | 97 | | | | |
| 136-154 | CCCAGCCAGGAAUUCCGCGCTsT | 31 | GCGCGGAAUUCCUGGCUGGGTsT | 32 | AD-9519 | | 78 | | | | |
| 136-154 | cccAGccAGGAuuccGcGcTsT | 33 | GCGCGGAAUCCUGGCUGGGTsT | 34 | AD-9646 | | 66 | | | | |
| 138-156 | CAGCCAGGAAUUCCGCGCGCTsT | 35 | GCGCGCGGAAGCCUGGCUGTsT | 36 | AD-9523 | | 55 | | | | |
| 138-156 | cAGccAGGAuuccGcGcGcTsT | 37 | GCGCGCGGAAUCCUGGCUGTsT | 38 | AD-9649 | | 60 | | | | |
| 185-203 | AGCUCCUGCACAGUCCUCCTsT | 39 | GGAGGACUGUGCAGGAGCUsT | 40 | AD-9569 | | 112 | | | | |
| 185-203 | AGcuccaGcAcAGuccuccTsT | 41 | GGAGGACUGCGcAGGAGCUsT | 42 | AD-9695 | | 102 | | | | |
| 205-223 | CACCGCAAGGCUCAAGGCGTT | 43 | CGCCUUGAGCCUUGCGGUGTT | 44 | AD-15222 | | | | 75 | | |
| 208-226 | CGCAAGGCUCAAGGCGCCGTT | 45 | CGGCGCCUUGAGCCUUGCGTT | 46 | AD-15278 | | | | 78 | | |
| 210-228 | CAAGGCUCAAGGCGCCGCCTT | 47 | GGCGGCGCCUUGAGCCUUGTT | 48 | AD-15178 | | | | 83 | | |
| 232-250 | GUGGACCGCGCACGGCCUCTT | 49 | GAGGCCGUGCGCGGUCCACTT | 50 | AD-15308 | | | | 84 | | |
| 233-251 | UGGACCGCGCACGGCCUCUTT | 51 | AGAGGCCGUGCGCGGUCCATT | 52 | AD-15223 | | | | 67 | | |
| 234-252 | GGACCGCGCACGGCCUCUATT | 53 | UAGAGGCCGUGCGCGGUCCTT | 54 | AD-15309 | | | | 34 | | |
| 235-253 | GACCGCGCACGGCCUCUAGTT | 55 | CUAGAGGCCGUGCGCGGUCTT | 56 | AD-15279 | | | | 44 | | |

-continued

| position in human access. # NM_174936 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | | IC50 in HepG 2 [nM] | IC50 in Cynomolgous monkey Hepatacyte [nM]s |
|---|---|---|---|---|---|---|---|---|---|---|---|---|
| | | | | | | 100 nM/ HepG 2 | 30 nM/ HepG 2 | 3 nM/ HepG 2 | 30 nM/ HeLa | | | |
| 236-254 | ACCGCCACGCCCUCUAGGTT | 57 | CCUAGAGGCCGUGCGCGGUTT | 58 | AD-15194 | | | | 63 | | | |
| 237-255 | CCGCGCACGGCCUCUAGGUTT | 59 | ACCUAGAGGCCGUGCGCGGTT | 60 | AD-15310 | | | | 42 | | | |
| 238-256 | CGCGCACGGCCUCUAGGUCTT | 61 | GACCUAGAGGCCGUGCGCGTT | 62 | AD-35311 | | | | 30 | | | |
| 239-257 | GCGCACGGCCUCUAGGUCUTT | 63 | AGACCUAGAGGCCGUGCGCTT | 64 | AD-15392 | | | | 18 | | | |
| 240-258 | CGCACGGCCUCUAGGUCUCTT | 65 | GAGACCUAGAGGCCCGUGCGTT | 66 | AD-15312 | | | | 21 | | | |
| 248-266 | CUCUAGGUCUCCUCGCCAGTT | 67 | CUGGCGAGGAGACCUAGAGTT | 68 | AD-15313 | | | | 19 | | | |
| 249-267 | UCUAGGUCUCCUCGCCAGGTT | 69 | CCUGGCGAGGAGACCUAGATT | 70 | AD-15280 | | | | 81 | | | |
| 250-268 | CUAGGUCUCCUCGCCAGGATT | 71 | GCCUGGCGAGGAGACCUAGTT | 72 | AD-15267 | | | | 82 | | | |
| 252-270 | AGGUCUCCUCGCCAGGACATT | 73 | GGUCCUGGCGAGGAGACCUTT | 74 | AD-15314 | | | | 32 | | | |
| 258-276 | CCUCGCCAGGACAGCAACCTT | 75 | GGUUGCUGUCCUGGCGAGGTT | 76 | AD-15315 | | | | 74 | | | |
| 300-318 | CGUCAGCUCCAGGCGGUCCTsT | 77 | GGACCGCCUGGAGCUGACGTsT | 78 | AD-9624 | | 94 | | | | | |
| 300-318 | cGucAGcuccAGGcGGuccTsT | 79 | GGACCGCCUGGAGCUGACGTsT | 80 | AD-9750 | | 96 | | | | | |
| 301-319 | GUCAGCUCCAGGCGGUCCUTsT | 81 | AGGACCGCCUGGAGCUGACTsT | 82 | AD-9623 | 43 | 66 | | | | | |
| 301-319 | GucAGcuccAGGcGGuccuTsT | 83 | AGGACCGCCUGGAGCUGACTsT | 84 | AD-9749 | | 105 | | | | | |

-continued

| position in human access. # NM_174936 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatocyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 370-388 | GGCGCCCGUGCGCAGGAGGTT | 85 | CCUCCUGCGCACGGGCGCCTT | 86 | AD-15384 | | | | 48 | | |
| 408-426 | GGAGCUGGUGCUAGCCUUGTsT | 87 | CAAGGCUAGCACCAGCUCCTsT | 88 | AD-9607 | | 32 | 28 | | 0.20 | |
| 408-426 | GGAGCuGGuGCuAGCcuuGTsT | 89 | cAAGGCuAGCACCAGCUCCTsT | 90 | AD-9733 | | 78 | 73 | | | |
| 411-429 | GCUGGGGCUAGCCUUGCGUTsT | 91 | ACGCAAGGCUAGCACCAGCTsT | 92 | AD-9524 | | 23 | 28 | | 0.07 | |
| 411-429 | GCuGGGCuAGccuuGcGuTsT | 93 | ACGuAAGGCuAGCACCAGCTsT | 94 | AD-9650 | | 91 | 90 | | | |
| 412-430 | CUGGUGCUAGCCUUGCGUUTsT | 95 | AACCGCAAGGCUAGCACCAGTsT | 96 | AD-9520 | | 23 | 32 | | | |
| 412-430 | CUGGUGCuAGCCUUGCGUUTsT | 97 | AACCGCAAGGCUAGCACCAGTsT | 98 | AD-9520 | | 23 | | | | |
| 412-430 | cuGGuGCuAGccuuGCGuTsT | 99 | AACCGCAAGGCuAGCACCAGTsT | 100 | AD-9646 | | 97 | 108 | | | |
| 416-434 | UGCCAGCCUUGCGUUCCGATsT | 101 | UCGGAACGCAAGGCUAGCATsT | 102 | AD-9608 | | 37 | | | | |
| 416-434 | uGCuAGccuuGCGuuccGATsT | 103 | UCGGAACGCAAGGCuAGCATsT | 104 | AD-9734 | | 91 | | | | |
| 419-437 | UAGCCUUGCGUUCCGAGGATsT | 105 | UCCUCGGAACGCAAGGCUATsT | 106 | AD-9546 | | 32 | | | | |
| 419-437 | uAGccuuGCGuuccGAGGATsT | 107 | UCCUCGGAACGcAAGGCuATsT | 108 | AD-9672 | | 57 | | | | |
| 439-457 | GACGGGCCUGGCCGAAGCACTT | 109 | GUGCUUCGGCCAGGCCGUCTT | 110 | AD-15385 | | | | 54 | | |
| 447-465 | GGCCGAAGCACCCGAGCACTT | 111 | GUGCUCGGGUGCUUCGGCCTT | 112 | AD-15393 | | | | 31 | | |

-continued

| position in human access. # NM_174936 | Sense strand sequence (5'-3')[1] | SEQ ID NO: | Antisense-strand sequence (5'-3'')[1] | SEQ ID NO: | Duplex name | Mean percent remaining mRNA transcript at siRNA concentration/in cell type | | | | IC50 in HepG2 [nM] | IC50 in Cynomolgous monkey Hepatocyte [nM]s |
|---|---|---|---|---|---|---|---|---|---|---|---|
| | | | | | | 100 nM/ HepG2 | 30 nM/ HepG2 | 3 nM/ HepG2 | 30 nM/ HeLa | | |
| 448-466 | GCCGAAGCACCCGAGCACGTT | 113 | CGUGCUUGGGUGCUUCGGCUTT | 114 | AD-15316 | | | | 37 | | |
| 449-467 | CCGAAGCACCCGAGCACCGTT | 115 | CCGUGCUCGGGUGCUUCGGTT | 116 | AD-15317 | | | | 37 | | |
| 458-476 | CCGAGACGGAACCACCAGCTT | 117 | GCUGUGGUUCCGUGCUCGGTT | 118 | AD-15195 | | | | 63 | | |
| 484-502 | CACCGCUGCGCCAAGGAUCTT | 119 | GAUCCUUGGCGCAGCGGUGTT | 120 | AD-15224 | | | | 45 | | |
| 486-504 | CCGCUGCGCCAAGGAUCCGTT | 121 | CGGAUCCUUGGCGCAGCGGTT | 122 | AD-15188 | | | | 57 | | |
| 487-505 | CGCUGCGCCAAGGAUCCGUTT | 123 | ACGGAUCCUUGGCGCAGCGTT | 124 | AD-15225 | | | | 42 | | |
| 489-507 | CUGCGCCAAGGAUCCGUGGTT | 125 | CCACGGAUCCUUGGCGCAGTT | 126 | AD-15281 | | | | 51 | | |
| 500-518 | AUCCGUGGAGGUUGCCUGGTT | 127 | CCAGGCAACCUCCACGGAUTT | 128 | AD-15282 | | | | 89 | | |
| 509-527 | GGUUGCCUGGCCACCUACGTT | 129 | ACGUAGGUGCCAGGCAACCTT | 130 | AD-15319 | | | | 75 | | |
| 542-560 | AGGAGACCCACCUCUCGCATT | 131 | UGCCGAGAGGUGGGUCUCCUTT | 132 | AD-15226 | | | | 61 | | |
| 543-561 | GGAGACCCACCUCUCGCAGTT | 133 | CUGCGAGAGGUGGGUCUCCTT | 134 | AD-15271 | | | | 56 | | |
| 544-562 | GAGACCCACCUCUCGCAGUTT | 135 | ACUGCGAGAGGUGGGUCUCTT | 136 | AD-15283 | | | | 25 | | |
| 549-567 | CCACCUCUCGCAGUCAGAGTT | 137 | CUCUGACUGCGAGAGGUGGTT | 138 | AD-15284 | | | | 25 | | |
| 552-570 | CCUCUCGCAGUCAGAGCGCTT | 139 | GCGCUCUGACUGCGAGAGGTT | 140 | | | | | 64 | | |

-continued

| position in human access. # NM_174936 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 553-571 | CUCUCCAGUCAGAGCGCATT | 141 | UGCGCUCUGACUGCGAGAGTT | 142 | AD-15189 | | | | 37 | | |
| 554-572 | UCUCGCAGUCAGAGCGCACTT | 143 | GUGCGCUCUGACUGCGAGATT | 144 | AD-15227 | | | | 62 | | |
| 555-573 | CUCGCAGUCAGAGCGCACUTsT | 145 | AGUGCGCUCUGACUGCGAGTsT | 146 | AD-9547 | | 31 | 29 | | 0.20 | |
| 555-573 | cucGcAGucAGAGcGcAcuTsT | 147 | AGUGCGCUCUGACUGCGAGTsT | 148 | AD-9673 | | 56 | 57 | | | |
| 558-576 | GCAGUCAGAGCGCACUGCCTsT | 149 | GGCAGUGCGCUCUGACUGCTsT | 150 | AD-9548 | | 54 | 60 | | | |
| 558-576 | GcAGucAGAGcGcAcuGccTsT | 151 | GGcAGUGCGCUCUGACUGCTsT | 152 | AD-9674 | | 36 | 57 | | | |
| 606-624 | GGGAUACCUCACCAAGAUCTsT | 153 | GAUCUUGGUGAGGUAUCCCTsT | 154 | AD-9529 | | 60 | | | | |
| 606-624 | GGGAUAccucAccAAGAucTsT | 155 | GAUCUUGGUGAGGuAUCCCTsT | 156 | AD-9655 | | 140 | | | | |
| 659-677 | UGGUGAAGAUGAGUGGGGATsT | 157 | UCGCCACUCAUCUUCACCATsT | 158 | AD-9605 | | 27 | 31 | | 0.27 | |
| 659-677 | uGGuGAAGAuGAGuGGGGATsT | 159 | UCGCcACUcAUCUUcACcATsT | 160 | AD-9731 | | 31 | 31 | | 0.32 | |
| 663-681 | GAAGAUGAGUGGCGACCUGTsT | 161 | CAGGUCGCCACUCAUCUUCTsT | 162 | AD-9596 | | 37 | | | | |
| 663-681 | GAAGAuGAGuGGcGAccuGTsT | 163 | cAGGUCGCcACUcAUCUUCTsT | 164 | AD-9722 | | 76 | | | | |
| 704-722 | CCCAUGUCGACUACAUCGATsT | 165 | UCGAUGUAGUCGACAUGGGTsT | 166 | AD-9583 | | 42 | | | | |
| 704-722 | cccAuGucGAcuAcAucGATsT | 167 | UCGAuGuAGUCGAcAUGGGTsT | 168 | AD-9709 | | 104 | | | | |

-continued

| position in human access. # NM_174936 | Sense strand sequence (5'-3')[1] | SEQ ID NO: | Antisense-strand sequence (5'-3')[1] | SEQ ID NO: | Duplex name | 100 nM/ HepG 2 | 30 nM/ HepG 2 | 3 nM/ HepG 2 | 30 nM/ HeLa | IC50 in HepG 2 [nM] | IC50 in Cynomolgous monkey Hepatocyte [nM]s |
|---|---|---|---|---|---|---|---|---|---|---|---|
| 718-736 | AUCGAGGAGGACUCCUCUGTsT | 169 | CAGAGGAGUCCUCCUCGAUTsT | 170 | AD-9579 | | 113 | | | | |
| 718-736 | AUcGAGGAGGAcucucuGTsT | 171 | cAGAGGAGUCCUCCUCGAUTsT | 172 | AD-9705 | | 81 | | | | |
| 758-776 | GGAACCUGGAGCGGAUUACTT | 173 | GUAAUCCGCUCCAGGUUCCTT | 174 | AD-15394 | | | | 32 | | |
| 759-777 | GAACCUGGAGCGGAUUACCTT | 175 | GGUAAUCCGCUCCAGGUUCTT | 176 | AD-15196 | | | | 72 | | |
| 760-778 | AACCUGGAGCGGAUUACCCTT | 177 | GGGUAAUCCGCUCCAGGUUTT | 178 | AD-15197 | | | | 85 | | |
| 777-795 | CCCUCCACGGUACCGGGCGTT | 179 | CGCCCGGUACCGUGGAGGGTT | 180 | AD-15198 | | | | 71 | | |
| 782-800 | CACGGUACCGGGCGGAUGATsT | 181 | UCAUCCGCCCGGUACCGUGTsT | 182 | AD-9609 | 66 | 71 | | | | |
| 782-800 | cAcGGuAccGGGcGGAuGATsT | 183 | UcAUCCGCCCGGuACCGUGTsT | 184 | AD-9735 | | 115 | | | | |
| 783-801 | ACGGUACCGGGCGGAUGAATsT | 185 | UUCAUCCGCCCGGUACCGUTsT | 186 | AD-9537 | | 145 | | | | |
| 783-801 | AcGGuAccGGGcGGAuGAATsT | 187 | UUcAUCCGCCCGGuACCGUTsT | 188 | AD-9663 | | 102 | | | | |
| 784-802 | CGGUACCGGGCGGAUGAAUTsT | 189 | AUUCAUCCGCCCGGUACCGTsT | 190 | AD-9528 | | 113 | | | | |
| 784-802 | cGGuAccGGGcGGAuGAAUTsT | 191 | AUUcAUCCGCCCGGuACCGTsT | 192 | AD-9654 | | 107 | | | | |
| 785-803 | GGUACCGGGCGGAUGAAUATsT | 193 | UAUUCAUCCGCCCGGuACCTsT | 194 | AD-9615 | | 49 | | | | |
| 785-803 | GGuAccGGGcGGAuGAAcATsT | 195 | uAUUcAUCCGCCCGGuACCTsT | 196 | AD-9641 | | 92 | | | | |

-continued

| position in human access. # NM_174936 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 786-804 | GUACCGGGCGAUGAAUACTsT | 197 | GUAUUCACCCGCCCGGUACTsT | 198 | AD-9514 | | 57 | | | | |
| 786-804 | GuAccGGGcGGAuGAAuACTsT | 199 | GuAUUcACCCGCCCGGuACTsT | 200 | AD-9640 | | 89 | | | | |
| 788-806 | ACCGGGCGGAUGAAUACCATsT | 201 | UGGUAUUCAUCCGCCCGGUTsT | 202 | AD-9530 | | 75 | | | | |
| 788-806 | AccGGGcGGAuGAAuAccATsT | 203 | UGGuAUUcAUCCGCCCGGUTsT | 204 | AD-9656 | | 77 | | | | |
| 789-807 | CCGGGCGGAUGAAUACCAGTsT | 205 | CUGGUAUUCCAUCCGCCCGGTsT | 206 | AD-9538 | 79 | 80 | | | | |
| 789-807 | ccGGGcGGAuGAAuAccAGTsT | 207 | CUGGuAUUcAUCCGCCCGGTsT | 208 | AD-9664 | | 53 | | | | |
| 825-843 | CCUGGUGGAGGUGUAUCUCTsT | 209 | GAGAUACACCUCCACCAGGTsT | 210 | AD-9598 | 69 | 83 | | | | |
| 825-843 | ccuGGuGGAGGuGuAucucTsT | 211 | GAGAuAcACCUCcACCAGGTsT | 212 | AD-9724 | | 127 | | | | |
| 826-844 | CUGGUGGAGGUGUAUCUCCTsT | 213 | GGAGAUACACCUCCACCAGTsT | 214 | AD-9625 | 58 | 88 | | | | |
| 826-844 | cuGGuGGAGGuGuAucuccTsT | 215 | GGAGAuAcACCUCcACcAGTsT | 216 | AD-9751 | | 60 | | | | |
| 827-845 | UGGGUGGAGGUGUAUCUCCUTsT | 217 | AGGAGAUACACCUCCACCATsT | 218 | AD-9556 | | 46 | | | | |
| 827-845 | uGGuGGAGGuGuAucuccuTsT | 219 | AGGAGAuAcACCUCcACCATsT | 220 | AD-9682 | | 38 | | | | |
| 828-846 | GGUGGAGGUGUAUCUCCUATsT | 221 | UAGGAGAUACACCUCCACCTsT | 222 | AD-9539 | 56 | 63 | | | | |
| 828-846 | GGuGGAGGuGuAucuccuATsT | 223 | uAGGAGAuAcACACCUGcACCTsT | 224 | AD-9665 | | 83 | | | | |

-continued

| position in human access. # NM_174936 | Sense strand sequence (5'-3')¹ | SEQ ID NO: | Antisense-strand sequence (5'-3')¹ | SEQ ID NO: | Duplex name | Mean percent remaining mRNA transcript at siRNA concentration/in cell type | | | | IC50 in HepG2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 831-849 | GGAGGUGUAUCUCCUAGACTsT | 225 | GUCUAGGAGAUACACCUCCTsT | 226 | AD-9517 | | 36 | | | | |
| 831-849 | GGAGGcGuAucuccuAGAcTsT | 227 | GUCuAGGAGAuAcACCUCCTsT | 228 | AD-9643 | | 40 | | | | |
| 833-851 | AGGUGUAUCUCCUAGAcACTsT | 229 | GUGUCUAGGAGAUACACCUTsT | 230 | AD-9610 | | 36 | 34 | | 0.04 | |
| 833-851 | AGGuGuAucuccuAGAcAcTsT | 231 | GUGUCuAGGAGAUAcACCUTsT | 232 | AD-9736 | | 22 | 29 | | 0.04 | |
| 833-851 | AfgGfuGfuAfucCfuCfcCfuAfgaCfacTsT | 233 | p-gUfgUfcUfaGfgAfgAfaAfcAcCfaTsT | 234 | AD-14681 | | | | 33 | | |
| 833-851 | AGGUfGUfAUfCfUfCfCfUfAGACfACfTsT | 235 | GGfGUfCfUfAGGAGAUfACfACCUfTsT | 236 | AD-14691 | | | 27 | | | |
| 833-851 | AgGuGuAaCacCuAgAcacTsT | 237 | p-gUfgUfcUfaGfgAfgAfuAfcAfcCfuTsT | 238 | AD-14701 | | | | 32 | | |
| 833-851 | AgGuGuAaCuCcUaGaCaCTsT | 239 | GUfGUfCfUfAGGAGAUfACfACCUfTsT | 240 | AD-14711 | | | | 33 | | |
| 833-851 | AfgGfuGfuAfucCfuCfcCfuAfgaCfacTsT | 241 | GUGUCuaGGagAUACAccuTsT | 242 | AD-14721 | | | | 22 | | |
| 833-851 | AGGUfGUfAUfCfUfCfCfUfAGACfACfTsT | 243 | GUGUCuaGGagAUACAccuTsT | 244 | AD-14731 | | | | 21 | | |
| 833-851 | AgGuGuAuCuCcUaGaCaCTsT | 245 | GUGUCuaGGagAUACAccuTsT | 246 | AD-14741 | | | | 23 | | |
| 833-851 | GfcAfcCfcCfcUfcAfuAfgGfcCfuGfgAfTsT | 247 | p-uCfcAfGGCfGcCfuAfcGfaGfcCfuGfcTsT | 248 | AD-15087 | | | | 37 | | |
| 833-851 | GCfACfCfCfCfCfUfCfAUfAGGCfCfUfUfGGATsT | 249 | UfCfCfAGGCfCfUfAUfAGGGGUfGCfTsT | 250 | AD-15097 | | | | 51 | | |
| 833-851 | GcAcCcUcAuAgGcCuGgATsT | 251 | p-aCfcAfgCfcCfuAfaGfaGfgAfgCfcTsT | 252 | AD-15107 | | | | 26 | | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomologous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 833-851 | GcAcCcUcAuAgGcCuGgATsT | 253 | UfCfcfAGGCfCfUfAUfGAGGGUfGCTsT | 254 | AD-15117 | | | | 28 | | |
| 833-851 | GfcAfcfcfUfcAfuAfgGfcfCfuGfgAfTsT | 255 | UCCAGgcCUauGAGGGugcTsT | 256 | AD-15127 | | | | 33 | | |
| 833-851 | GcfAcfCfcfUfuFCfcfAUfAGGGfCfCfUfGGATsT | 257 | UCCAGgcCUauGAGGGugcTsT | 258 | AD-15137 | | | | 54 | | |
| 833-851 | GcAcCcUcAuAgGcCuGgATsT | 259 | UCCAGgcCUauGAGGGugcTsT | 260 | AD-15147 | | | | 52 | | |
| 836-854 | UGUAUCCCUUAGACACCAGTsT | 261 | CUGGUGUCUAGGAGAUACATsT | 262 | AD-9516 | | 94 | | | | |
| 836-854 | uGuAucuccuuAGAcAccAGTsT | 263 | CUGGUGUCuAGGAGAuAcATsT | 264 | AD-9642 | | 105 | 51 | | | |
| 840-858 | UCUCCUAGACACCACCAUATsT | 265 | UAUGCUGGUGUCUAGGAGATsT | 266 | AD-9562 | | 46 | 34 | | | |
| 840-858 | ucuccuAGAccAGcAuATsT | 267 | uAUGCUGGUGcUAGGAGATsT | 268 | AD-9688 | | 26 | | | 4.20 | |
| 840-858 | UfcUfcfuAfgAfcAfcCfaGfcAfuAfTsT | 269 | p-uAfuGfcUfgGfuGfucfuAfgGfaGfaTsT | 270 | AD-14677 | | | | 38 | | |
| 840-858 | UfcUfcfcfuAfgAGACfACfCfAGCfAUfATsT | 271 | UfAUfGCfUfGGUfGUfCfUfAGGAGATsT | 272 | AD-14687 | | | | 52 | | |
| 840-858 | UcUcCuAgAcAcCaGcAuATsT | 273 | p-uAfuGfcUfgGfuCfuAfgGfaGfaTsT | 274 | AD-14697 | | | | 35 | | |
| 840-858 | UcUcCuAgAcAcCuGcAuATsT | 275 | UfAUfGCfUfGGUfCfUfAGGAGATsT | 276 | AD-14707 | | | | 58 | | |
| 840-858 | UfcUfcfcfuAaFcAfcCfaGfcAfuAfTsT | 277 | UAUGCugGUguCUAGGagaTsT | 278 | AD-14717 | | | | 42 | | |
| 840-858 | UfcCfcfcfUfcfAGACfACfCfAGCfAUfATsT | 279 | UAUGCugGUguCUAGGugaTsT | 280 | AD-14727 | | | | 50 | | |

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 840-858 | UcGcCuAgAcAcCaGcAcATsT | 281 | UAGCGugUguCuAGGagaTsT | 282 | AD-14737 | | | | 32 | | |
| 840-858 | AfgGfcCfuGfgAfgUfuUfaUfuCfgGfTsT | 283 | p-cCfgAfaUfaAfaCfaCfcAfgGfcCfuTsT | 284 | AD-15083 | | | | 16 | | |
| 840-858 | AGGCfCfUfGfGAGUfUfCfAUfUfCfCfGGTsT | 285 | CfCfGAAUfAAACfGfCfCfAGGCfCfuTsT | 286 | AD-15093 | | | | 24 | | |
| 840-858 | AgGcCfUfGfGAgUfuUfaUfuCfgGfTsT | 287 | p-cCfgAfaUfaAfuCfuCfcAfgGfcCfuTsT | 288 | AD-15103 | | | | 11 | | |
| 840-858 | AfgGfcCfuGfgAfgUfuUfaUfuCfgGfTsT | 289 | CfCfGAAUfAAACfUfCfCfAGGCfCfUfTsT | 290 | AD-15113 | | | | 34 | | |
| 840-858 | AfgGgcCfuGfgAfgUfuUfaUfuCfgGfTsT | 291 | CCGAAuaAAcuCCAGGccuTsT | 292 | AD-15123 | | | | 19 | | |
| 840-858 | AGGCfCfUfGfGAGUfUfUfAUfUfCfGGTsT | 293 | CCGAAuaAAcuCCAGGccuTsT | 294 | AD-15133 | | | | 15 | | |
| 840-858 | AgGcCfGgAgUfCfUfaUfcCfgTsT | 295 | CCGAAuaAAcuCCAGGccuTsT | 296 | AD-15143 | | | | 16 | | |
| 841-859 | CUCCUAGACACCAGCAUACTsT | 297 | GUAUGCUGGUGUCUAGGAGTsT | 298 | AD-9521 | | 50 | | | | |
| 841-859 | cuccuAGAcAccAGcAuAcTsT | 299 | GuAUGCUGGUGUCUaAGGAGTsT | 300 | AD-9647 | | 62 | | | | |
| 842-860 | UCCUAGACACCAGCAUACATsT | 301 | UGUAUGCUGGUGUCUAGGATsT | 302 | AD-9611 | | 48 | | | | |
| 842-860 | uccuAGAcAccAGcAuAcATsT | 303 | UGcAUGCUGGUGUCUaAGGATsT | 304 | AD-9737 | 46 | 68 | | | | |
| 843-861 | CCUAGACACCAGCAUACAGTsT | 305 | CUGUAUGCUGGUGUCUAGGTsT | 306 | AD-9592 | | 55 | | | | |
| 843-861 | ccuAGAcAccAGcAuAcAGTsT | 307 | CUGuAUGCUGGUGUCUaAGGTsT | 308 | AD-9718 | | 78 | | | | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 847-865 | GACACCAGCAUACAGAGUGTsT | 309 | CACUCUGUAUGCUGGUGUCTsT | 310 | AD-9561 | | 64 | | | | |
| 847-865 | GAcAccAGcAuAcAGAGuGTsT | 311 | cACGCUGuAUGCUGGUGUCTsT | 312 | AD-9687 | | 84 | | | | |
| 855-873 | CAUACAGAGUGACCACCGGTsT | 313 | CCGGUGGUCACUCUGUACGTsT | 314 | AD-9762 | | 42 | 41 | | 2.10 | |
| 855-873 | cAuAcAGAGuGAccAccGGTsT | 315 | CCGGUGGUcACUCUGuAUGTsT | 316 | AD-9762 | | 9 | 28 | | 0.40 | |
| 860-878 | AGAGUGACCACCGGAAAUTsT | 317 | AUUUCCCGGUGGUCACUCUTsT | 318 | AD-9540 | | 45 | | | | |
| 860-878 | AGAGuGAccAccGGGAAAUTsT | 319 | AUUUCCCGGUGGUcACUCUTsT | 320 | AD-9666 | | 81 | | | | |
| 861-879 | GAGUGACCACCGGAAAUCTsT | 321 | GAUUUCCCGGUGGUCACUCTsT | 322 | AD-9535 | 48 | 73 | | | | |
| 861-879 | GAGuGAccAccGGGAAAccTsT | 323 | GAUUUCCCGGUGGUcACUCTsT | 324 | AD-9661 | | 83 | | | | |
| 863-881 | GUGACCACCGGGAAAUCGATsT | 325 | UCGAUUUCCCGGUGGUCACTsT | 326 | AD-9559 | | 35 | | | | |
| 863-881 | GuGAccAccGGGAAAUcGATsT | 327 | UCGAUUUCCCGGUGGUcACTsT | 328 | AD-9685 | | 77 | | | | |
| 865-883 | GACCACCGGGAAAUCGAGGTsT | 329 | CCUCGAUUUCCCGGUGGUCTsT | 330 | AD-9533 | | 100 | | | | |
| 866-884 | ACCACCGGGAAAUCGAGGGTsT | 331 | CCCUCGAUUUCCCGGUGGUTsT | 332 | AD-9659 | | 88 | | | | |
| 866-884 | ACCACCGGGAAAUCGAGGGTsT | 333 | CCCUCGAUUUCCCGGUGGUTsT | 334 | AD-9612 | | 122 | | | | |
| 866-884 | AccAccGGGAAAUcGAGGGTsT | 335 | CCCUCGAUUUCCCGGUGGUTsT | 336 | AD-9738 | | 83 | | | | |

| position in human access. # NM_17493 6 | SEQ ID NO: | Sense strand sequence (5'-3')¹ | SEQ ID NO: | Antisense-strand sequence (5'-3')¹ | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 867-885 | 337 | CCAccGGGAAAUcGAGGGCTsT | 338 | GCCCUCGAUUUCCCGUGGTsT | AD-9557 | 75 | 96 | | | | |
| 867-885 | 339 | cCAccGGGAAAUcGAGGGCTsT | 340 | GCCCUCGAUUUCCCGUGGTsT | AD-9683 | | 48 | | | | |
| 875-893 | 341 | AAAUCGAGGGCcAGGGUCAUTsT | 342 | AUGACCCUGCCCUCGAUUUTsT | AD-9531 | | 31 | 32 | | 0.53 | |
| 875-893 | 343 | AAAUcGAGGGcAGGGUcAUTsT | 344 | AUGACCCUGCCCUCGAUUUTsT | AD-9657 | | 23 | 29 | | 0.66 | |
| 875-893 | 345 | AfaAfuCfGfAfGfGfCfaGfgfcCfaUfUfTsT | 346 | p-aUfgAfcCfcUfgCfcCfuCfgAfuUfuUfTsT | AD-14673 | | | | 81 | | |
| 875-893 | 347 | AAAUCfGAGGGCfAGGGUfCfAUfTsT | 348 | AUfGACfCfCfUfGCfCfCfUfCfGAUfUfTsT T | AD-14683 | | | | 56 | | |
| 875-893 | 349 | AaAuCgAgGgCaGGGuCaUTsT | 350 | p-aUfgAfcCfcUfgCfcCfuCfgAfuUfuUfTsT | AD-14693 | | | | 56 | | |
| 875-893 | 351 | AaAuCgAgGgCaGgGuCaUTsT | 352 | AUfGACfCfCfUfGCfCfCfUfCfGAUfUfUfTs T | AD-14703 | | | | 68 | | |
| 875-893 | 353 | AfaAfuCfGfAfGfGfCfaGfgfcCfaUfUfTsT | 354 | AUGACccUGccCUCGAuuuTsT | AD-14713 | | | | 55 | | |
| 875-893 | 355 | AAAUCfGAGGGCfAGGGUfCfAUfTsT | 356 | AUGACccUGccCUCGAuuuTsT | AD-14723 | | | | 24 | | |
| 87-893 | 357 | AuAuCgAgggCaGggCaUTsT | 358 | AUGAcccUGccCUCGAuuuTsT | AD-14733 | | | | 34 | | |
| 85-893 | 359 | CfGfGgCfAfcCfcUfCfAfuAfGfCfCfuGfTsT | 360 | p-cAfgGfcCfuAfuGfaGfgGfuGfcCfgTsT | AD-15079 | | | | 85 | | |
| 875-893 | 361 | CfGGCfACfCfCfUfCfAUfAGGCfCfUfGTsT | 362 | CfAGGCfCfUfAUfGAUfGGGfGfCfCfUfGTsT | AD-15089 | | | | 54 | | |
| 875-893 | 363 | CgGcAccCcUcAuAgGcCuGTsT | 364 | p-cAfgGfcCfuAfuGfaGfgGfuGfcCfgTsT | AD-15099 | | | | 70 | | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomologous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 875-893 | GcGcAccCUcAuAgGcCcGTsT | 365 | CfAGGcCfCfUfAUfGAGGUfGCfCfGTsT | 366 | AD-15109 | | | | 67 | | |
| 875-893 | CfgGgcAfcCfcUfcAfuAfgGgcCfuGfTsT | 367 | CAGGCcuAUgaGGGUGCccgTsT | 368 | AD-15119 | | | | 67 | | |
| 875-893 | CfGGCfACfCfUfCfUfAUfAGGCfCfUfGTsT | 369 | CAGGCcuAUgaGGGUGCccgTsT | 370 | AD-15129 | | | | 57 | | |
| 875-893 | CgGcAccCUcAuAgGcCuGTsT | 371 | CAGGCcuAgaGGGUGCccgTsT | 372 | AD-15139 | | | | 69 | | |
| 877-895 | AUcGAGGGcCAGGGCAUGGTsT | 373 | CCAUGACCCUGCCCUCGAUTsT | 374 | AD-9542 | | 160 | | | | |
| 877-895 | AucGAGGGcCAGGGcAuGGTsT | 375 | CcAUGACCCUGCCCUCGAUTsT | 376 | AD-9668 | | 92 | | | | |
| 878-896 | cGAGGGcCAGGGcAGGGucAuGucTsT | 377 | GACCAUGACCCUGCCCUCGTsT | 378 | AD-9739 | | 109 | | | | |
| 880-898 | GAGGGGcCAGGGUCAUGGUCATsT | 379 | UGACCAUGACCCUGCCCUCTsT | 380 | AD-9637 | 56 | 83 | | | | |
| 880-898 | GAGGGcCAGGGUcAuGGucATsT | 381 | UGAccAUGACCCUGCCCUCTsT | 382 | AD-9763 | | 79 | | | | |
| 882-900 | GGGCAGGGUCAUGGUCACCTsT | 383 | GGUGACCAUGACCCUGCCCTsT | 384 | AD-9630 | | 82 | | | | |
| 882-900 | GGGcAGGGUcAuGGucAccTsT | 385 | GGUGAccAUGACCCUGCCCTsT | 386 | AD-9756 | | 63 | | | | |
| 885-903 | CAGGGUCAUGGUCACCGACTsT | 387 | GUCGGUGACCAUGACCCUGTsT | 388 | AD-9593 | | 55 | | | | |
| 885-903 | cAGGGUcAcGGUcAccGAcTsT | 389 | GUCGGUGAccAUGACCCUGTsT | 390 | AD-9719 | | 115 | | | | |
| 886-904 | AGGGUCAUGGUCACCGACUTsT | 391 | AGUCGGUGACCAUGACCCUTsT | 392 | AD-9601 | | 111 | | | | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomol- gous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 886-904 | AGGGuCAuGGucAccGAcuTsT | 393 | AGUCGGUGACCAUGACCCUTsT | 394 | AD-9727 | | 118 | | | | |
| 892-910 | AUGGUCACCGACUUCGAGATsT | 395 | UCUCGAAGUCGGUGACCAUTsT | 396 | AD-9573 | | 36 | 42 | | 1.60 | |
| 892-910 | AuGGUcAccGAcuucGAGATsT | 397 | UCUCGAAGUCGGUGACcAUTsT | 398 | AD-9699 | | 32 | 36 | | 2.50 | |
| 899-917 | CCGACUUCGAGAAAUGCCTT | 399 | GGCACAUUCUCGAAGUCGGTT | 400 | AD-15228 | | | | 26 | | |
| 921-939 | GGAGGACGGGACCCGCUUCTT | 401 | GAAGCGGGUCCCGUCCUUCTT | 402 | AD-15395 | | | | 53 | | |
| 993-1011 | CAGCGGCCGGGAUGCGCGGTsT | 403 | GCCGCAUCCCGGCCGCUGTsT | 404 | AD-9602 | | 126 | | | | |
| 993-1011 | cAGcGGccGGGAuGccGCTsT | 405 | GCCCGCAUCCCGGCCGCUGTsT | 406 | AD-9728 | | 94 | | | | |
| 1020-1038 | GGGUGCCAGCAUGCGCAGCTT | 407 | GCUGCGCAUGCUGGCACCCTT | 408 | AD-15386 | | | | 45 | | |
| 1038-1056 | CCUGCGCGUGCUCAACUGCTsT | 409 | GCAGUUGAGCACGCGCAGGTsT | 410 | AD-9580 | | 112 | | | | |
| 1038-1058 | UGCGCGUGCUCAACUGCCATsT | 411 | GcAGUUGAGCACGCGCAGTsT | 412 | AD-9706 | | 86 | | | | |
| 1040-1058 | UGCGCGUGCUCAACUGCCATsT | 413 | UGGCAGUUGAGCACGCGCATsT | 414 | AD-9581 | | 35 | | | | |
| 1040-1058 | uGcGcGuGcucAAcuGccATsT | 415 | UGGcAGUUGAGcACGCGcATsT | 416 | AD-9707 | | 81 | | | | |
| 1042-1060 | CGCGUGCUCACUGCCAAGTsT | 417 | CUUGGCAGUUGAGcACGCGTsT | 418 | AD-9543 | | 51 | | | | |
| 1042-1060 | cGcGuGcucAAcuGccAAGTsT | 419 | CUUGGcAGUUGAGcACGCGTsT | 420 | AD-9669 | | 97 | | | | |

-continued

| position in human access. # NM_17493 6 | Sense strand sequence (5'-3')¹ | SEQ ID NO: | Antisense-strand sequence (5'-3')¹ | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 1053-1071 | CUGCCAAGGGAAGGGCACGTsT | 421 | CGUGCCCUUCCCUUGGCAGTsT | 422 | AD-9574 | | 74 | | | | |
| 1053-1071 | cuGccAAGGGAAGGGcAcGTsT | 423 | CGUGCCCUUCCCUUGGcAGTsT | 424 | AD-9700 | | | | | | |
| 1057-1075 | CAAGGGAAGGGCACGUUAUU | 425 | UAACCGUGCCCUUCCCUGUTT | 426 | AD-15320 | | | | 26 | | |
| 1058-1076 | AAGGGAAGGGCACGUUAGUU | 427 | CUAACCGUGCCCUUCCCUUTT | 428 | AD-15321 | | | | 34 | | |
| 1059-1077 | AGGGAAGGGCACGUUAGCUU | 429 | GCUAACCGUGCCCUUCCCUTT | 430 | AD-15199 | | | | 64 | | |
| 1060-1078 | GGGAAGGGCACGUUAGCGUU | 431 | CGCUAACCGUGCCCUUCCCTT | 432 | AD-15167 | | | | 86 | | |
| 1061-1079 | GGAAGGGCACGUUAGCGGUU | 433 | CCGCUAACCGUGCCCUUCCTT | 434 | AD-15164 | | | | 41 | | |
| 1062-1080 | GAAGGGCACGUUAGCGGCUU | 435 | GCCGCUAACCGUGCCCUUCTT | 436 | AD-15166 | | | | 43 | | |
| 1063-1081 | AAGGGCACGUUAGCGGCAUU | 437 | UGCCGCUAACCGUGCCCUUTT | 438 | AD-15322 | | | | 64 | | |
| 1064-1082 | AGGGCACGUUAGCGGCACUU | 439 | GCGCCGCUAACCGUGCCCUTT | 440 | AD-15200 | | | | 46 | | |
| 1068-1086 | CACGUUAGCGGCACCCUCUU | 441 | GAAGGGUGCCGCUAACCGUGTT | 442 | AD-15213 | | | | 27 | | |
| 1069-1087 | ACGUUAGCGGCACCCUCAUU | 443 | UGAGGGUGCCGCUAACCGUTT | 444 | AD-15229 | | | | 44 | | |
| 1072-1090 | GUUAGCGGCACCCUCUAUGUU | 445 | CUAUGAGGGUGCCGCUAACUU | 446 | AD-15215 | | | | 49 | | |
| 1073-1091 | UUAGCGGCACCCUCUAUAGGUU | 447 | CCUAUGAGGGUGCCGCCCUAAUU | 448 | AD-15214 | | | | 101 | | |

-continued

| position in human access. # NM_17493 6 | Sense strand sequence (5'-3')¹ | SEQ ID NO: | Antisense-strand sequence (5'-3')¹ | SEQ ID NO: | Duplex name | Mean percent remaining mRNA transcript at siRNA concentration/in cell type | | | | IC50 in HepG 2 [nM] | IC50 in Cynomolgous monkey Hepatocyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 1076-1094 | GCGGCACCCUCAUAGGCCUTsT | 449 | AGGCCUAUGAGGUGCCGCTsT | 450 | AD-9315 | | 15 | 32 | | 0.98 | |
| 1079-1097 | GCACCCUCAUAGGCCUUGATsT | 451 | UCCAGGCCUAUGAGGGUGCTsT | 452 | AD-9326 | | 35 | 51 | | | |
| 1085-1103 | UCAUAGGCCUGGAGUUUAUTsT | 453 | AUAAACUCCAGGCCUAUGATsT | 454 | AD-9318 | | 14 | 37 | | 0.40 | |
| 1090-1108 | GGCCUGGAGUUUAUUCGGATsT | 455 | UCCGAAUAAACUCCAGGCCTsT | 456 | AD-9323 | | 14 | 33 | | | |
| 1091-1109 | GCCUGGAGUUUAUUCGGAATsT | 457 | UUCCGAAUAAACUCCAGGCTsT | 458 | AD-9314 | | 11 | 22 | | 0.04 | |
| 1091-1109 | GccuGGAGuuuAuccGAATsT | 459 | UUCCGAAUAAACUcCAGGCTsT | 460 | AD-10792 | | | | | 0.10 | 0.30 |
| 1091-1109 | GccuGGAGuuuAuccGAATsT | 461 | UUCCGAAUAACUCCAGGCTsT | 462 | AD-10796 | | | | | 0.1 | 0.1 |
| 1093-1111 | CUGGAGUUUAUUCGGAAATsT | 463 | UUUUCCGAUAAACUCCAGTsT | 464 | AD-9638 | | 101 | | | | |
| 1093-1111 | cuGGAGuuuAuucGGAAATsT | 465 | UUUUCCGAuAAACUCcAGTsT | 466 | AD-9764 | | 112 | | | | |
| 1095-1113 | GGAGUUUAUUCGGAAAAGCTsT | 467 | GCUUUUCCGAAUAAACUCCTsT | 468 | AD-9525 | | 53 | | | | |
| 1095-1113 | GGAGuuuAuucGGAAAAGCTsT | 469 | GCUUUUCCGAAuAAACUCCTsT | 470 | AD-9651 | | 58 | | | | |
| 1096-1114 | GAGUUUAUUCGGAAAAGCTsT | 471 | GGCUUUUCCGAAUAAACUCTsT | 472 | AD-9560 | | 97 | | | | |
| 1096-1114 | GACuuuAuccGAAAAGcCTsT | 473 | GGCUUUUCCGAAuAAACUCTsT | 474 | AD-9686 | | 111 | | | | |
| 1100-1118 | UUAUUCCGAAAAGCCAGCUTsT | 475 | AGCUGGCUUUUCCGAAUAATsT | 476 | AD-9536 | | 157 | | | | |

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 1100-1118 | uuAuucGGAAAAGcCAGcuTsT | 477 | AGCUGGCUUUUCCGAAuAATsT | 478 | AD-9662 | | 81 | | | | |
| 1154-1172 | CCCUGGGGGGUGGGUACAGTsT | 479 | CUGUACCCACCCGCCAGGGTsT | 480 | AD-9584 | 52 | 68 | | | | |
| 1154-1172 | cccuGGGGGGUuGGGuAcAGTsT | 481 | CUGACCCaCCCCGCCAGGGTsT | 482 | AD-9710 | | 111 | | | | |
| 1155-1173 | CCUGGGGGGUGGGUACAGCTT | 483 | GCUGUACCCACCCCGCCAGGTT | 484 | AD-15323 | | | | 62 | | |
| 1157-1175 | UGGCGGGUGGGUACAGCCGTsT | 485 | CGGCUGUACCCACCCGCCGTsT | 486 | AD-9551 | | 91 | | | | |
| 1157-1175 | uGGcGGGuGGGuAcAGccGTsT | 487 | CGGCUGUACCCaCCCGCCATsT | 488 | AD-9677 | | 62 | | | | |
| 1158-1176 | GGCGGGUGGGUACAGCCGCTT | 489 | GCGGCUGUACCCACCCGCCTT | 490 | AD-15230 | | | | 52 | | |
| 1162-1180 | GGUGGGUACAGCCGCGUCCTT | 491 | GGACGCGGCUGUACCCACCTT | 492 | AD-15231 | | | | 25 | | |
| 1164-1182 | UGGGUACAGCCGCGUCCUTT | 493 | GAGGACGCGGCUGUACCCATT | 494 | AD-15285 | | | | 36 | | |
| 1172-1190 | GCCGCGUCCUCAACGCCGCTT | 495 | GCGGCGUUGAGGACGCGGCTT | 496 | AD-15396 | | | | 27 | | |
| 1173-1191 | CCGCGUCCUCAACGCCGCTT | 497 | GGCCGCGUUGAGGACGCGGTT | 498 | AD-15397 | | | | 36 | | |
| 1216-1234 | GUCGUGCUGGUCACCCGCUGTsT | 499 | CAGCGGGUGACCAGCACGACTsT | 500 | AD-9600 | | 112 | | | | |
| 1216-1234 | GucGuGcuGGucAccGcuGTsT | 501 | cAGCGGUGACCAGCACGACTsT | 502 | AD-9726 | | 95 | | | | |
| 1217-1235 | UCGUGCUGGUCACCCGCUGCTsT | 503 | GCAGCGGGUGACCAGCACGATsT | 504 | AD-9606 | | 107 | | | | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomologous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 1217-1235 | ucGuGcuGGucAccGcuGcTsT | 505 | GcAGcGGuGAcCaGcACGATsT | 506 | AD-9732 | | 105 | | | | |
| 1223-1241 | UGGUCAccGCCUGCCGGCAATsT | 507 | UUGCCGGcAGCGGUGACCATsT | 508 | AD-9633 | 56 | 75 | | | | |
| 1223-1241 | uGGucAccGcuGcCGGcAATsT | 509 | UUGCCGGcAGCGGUGAccATsT | 510 | AD-9759 | | 111 | | | | |
| 1224-1242 | GGUCACCGCuGCCGGCAACTsT | 511 | GUUGCCGGcAGCGGUGACCTsT | 512 | AD-9588 | | 66 | | | | |
| 1224-1242 | GGucAccGcuGccGGcAAcTsT | 513 | GUUGCCGGcAGCGGUGACCTsT | 514 | AD-9714 | | 106 | | | | |
| 1227-1245 | CACCGCUGCCGGCAACUUCTsT | 515 | GAAGUUGCCGGcAGCGGUGTsT | 516 | AD-9589 | 67 | 85 | | | | |
| 1227-1245 | cAccGcuGccGGcAAcuucTsT | 517 | GAAGUUGCCGGcAGCGGUGTsT | 518 | AD-9715 | | 113 | | | | |
| 1229-1247 | CCGCUGCCGGCAACUUCCGTsT | 519 | CGGAAGUUGCCGGcAGCGGTsT | 520 | AD-9575 | | 120 | | | | |
| 1229-1247 | cCGcuGccGGcAAcuucCGTsT | 521 | CGGAAGUUGCCGGcAGCGGTsT | 522 | AD-9701 | | 100 | | | | |
| 1230-1248 | CGCUGCCGGCAACUUCCGGTsT | 523 | CCGGAAGUUGCCGGcAGCGTsT | 524 | AD-9563 | | 103 | | | | |
| 1230-1248 | cGcuGccGGcAAuuccGGTsT | 525 | CCGGAAGUUGCCGGcAGCGTsT | 526 | AD-9689 | | 81 | | | | |
| 1231-1249 | GCUGCCGGCAACUUCCGGGTsT | 527 | CCCGGAAGUUGCCGGCAGCTsT | 528 | AD-9594 | 80 | 95 | | | | |
| 1231-1249 | GcuGccGGcAAcuucCGGGTsT | 529 | CCCGGAAGUUGCCGGcAGCTsT | 530 | AD-9720 | | 92 | | | | |
| 1236-1254 | CGGCAACUUCCCGGACCAUTsT | 531 | AUCGUCCCGAAGUUGCCGTsT | 532 | AD-9585 | | 83 | | | | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 1236-1254 | cGGcAAcuuccGGGAcGAuTsT | 533 | AUCGUCCCGGAAGUUGCCGTsT | 534 | AD-9711 | | 122 | | | | |
| 1237-1255 | GGcAACUUCCGGGACGAUGTsT | 535 | CAUCGUCCCGGAAGUUGCCTsT | 536 | AD-9614 | | 100 | | | | |
| 1237-1255 | GGcAAcuuccGGGAcGAuGTsT | 537 | cAUCGUCCCGGAAGUUGCCTsT | 538 | AD-9740 | | 198 | | | | |
| 1243-1261 | UUCCGGGACGAUGCCUGCCTsT | 539 | GGCAGGCAUGGUCCCGGAATsT | 540 | AD-9615 | | 116 | | | | |
| 1243-1261 | uuccGGGAcGAuGccuGccTsT | 541 | GGcAGGcAUGGUCCCGGAATsT | 542 | AD-9741 | | 130 | | | | |
| 1248-1266 | GGACGAUGCCUGCCUCUACTsT | 543 | GUAGAGGcAGGcAUCGUCCTsT | 544 | AD-9534 | 32 | 30 | | | | |
| 1248-1266 | GGACGAUGCCUGCCUCUACTsT | 545 | GUAGAGGCAGGCAUCGUCCTsT | 546 | AD-9534 | | 32 | | | | |
| 1248-1266 | GGAcGAuGccuGccucuAcTsT | 547 | GuAGAGGcAGGcAUCGUCCTsT | 548 | AD-9660 | | 89 | 79 | | | |
| 1279-1297 | GCUCCCGAGGUCAUCACAGTT | 549 | CUGUGAUGACCUCGGGAGCTT | 550 | AD-15324 | | | | 46 | | |
| 1280-1298 | CUCCCGAGGUCAUCACAGUTT | 551 | ACUGUGAUGACCUCGGGAGTT | 552 | AD-15232 | | | | 19 | | |
| 1281-1299 | UCCCGAGGUCAUCACAGUUTT | 553 | AACUGUGAUGACCUCGGGATT | 554 | AD-15233 | | | | 25 | | |
| 1314-1332 | CCAAGACCAGCCGGUGACCTT | 555 | GGUCACCGGCUGGUCUUGGTT | 556 | AD-15234 | | | | 59 | | |
| 1315-1333 | CAAGACCAGCCGGUGACCCTT | 557 | GGGUCACCGGCUGGUCUUGTT | 558 | AD-15286 | | | | 109 | | |
| 1348-1366 | ACCAACUUUGGCCGCUGUGTsT | 559 | CACAGCGGCcAAAGUUGGUTsT | 560 | AD-9590 | | 122 | | | | |

| position in human access. # NM_17493 6 | Sense strand sequence (5'-3')[1] | SEQ ID NO: | Antisense-strand sequence (5'-3')[1] | SEQ ID NO: | Duplex name | 100 nM/ HepG 2 | 30 nM/ HepG 2 | 3 nM/ HepG 2 | 30 nM/ HeLa | IC50 in HepG 2 [nM] | IC50 in Cynomol- gous monkey Hepatacyte [nM]s |
|---|---|---|---|---|---|---|---|---|---|---|---|
| 1348-1366 | AccAAcuuuGGccGcuGuGTsT | 561 | cACAGCGGccAAAGUUGGUTsT | 562 | AD-9716 | | 114 | | | | |
| 1350-1368 | CAACUUUGGCCCUGUGUGTsT | 563 | CACACAGCGCCAAAGUUGTsT | 564 | AD-9632 | | 34 | | | | |
| 1350-1368 | cAAcuuuGGccGcuGuGuGTsT | 565 | cAcAcAGCGGCcAAAGUUGTsT | 566 | AD-9758 | | 96 | | | | |
| 1360-1378 | CGCUGUGUGGACCUCUUUGTsT | 567 | CAAAGAGGUCCACACACAGCGTsT | 568 | AD-9567 | | 41 | | | | |
| 1360-1378 | cGcuGuGuGGAccucuuuGTsT | 569 | cAAAGAGGUCcAcAcAGCGTsT | 570 | AD-9693 | | 50 | | | | |
| 1390-1408 | GACACAUUGGUGCCUCCATsT | 571 | UGGAGGCACCAAUGAUGUCTsT | 572 | AD-9586 | 81 | 104 | | | | |
| 1390-1408 | GAcAcAuuGGuGcccuccATsT | 573 | UGGAGGcAccAAUGAUGUCTsT | 574 | AD-9712 | | 107 | | | | |
| 1394-1412 | UCAUUGGUGCCUCCAGCGATsT | 575 | UCGCUGGAGGCACCAAUGATsT | 576 | AD-9564 | | 120 | | | | |
| 1394-1412 | ucAuuGGuGccuccAGcGATsT | 577 | UCGCUGGAGGcAccAAUGATsT | 578 | AD-9690 | | 92 | | | | |
| 1417-1435 | AGCACCUGCUUUUGUGUCACTsT | 579 | GUGACACAAAGCAGGUGCUTsT | 580 | AD-9616 | 74 | 84 | | | | |
| 1417-1435 | AGcAccuGcuuuuGcGucAcTsT | 581 | GUGAcAcAAAGcAGGUGCUTsT | 582 | AD-9742 | | 127 | | | | |
| 1433-1451 | CACAGAGUGGGACAUCACATT | 583 | UGUGAUGUCCCACUCUGUTT | 584 | AD-15398 | | | | 24 | | |
| 1486-1504 | AUGCUGUCUGCCGAGCGGTsT | 585 | CCGGCUCGGCAGCAGCAUTsT | 586 | AD-9617 | | 111 | | | | |
| 1486-1504 | AuGcuGucuGccGAGcGGTsT | 587 | CCGGCUCGGcAGAcAGcAUTsT | 588 | AD-9743 | | 104 | | | | |

-continued

| position in human access. # NM_174936 | Sense strand sequence (5'-3')¹ | SEQ ID NO: | Antisense-strand sequence (5'-3')¹ | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 1491-1509 | GUCUGCCGAGCCGGAGCUCTsT | 589 | GAGCUCCGGCUCGGCAGACTsT | 590 | AD-9635 | 73 | 90 | | | | |
| 1491-1509 | GUcuGccGAGccGGAGcucTsT | 591 | GAGCUCCGGCUCGGcAGACTsT | 592 | AD-9761 | | 83 | | | | |
| 1521-1539 | GUUGAGGCAGAGACUGAUCTsT | 593 | GAUCAGUCUCUGCCUCAACTsT | 594 | AD-9568 | | 76 | | | | |
| 1521-1539 | GuuGAGGcAGAGAcuGAucTsT | 595 | GAUcAGUCUCUGCCUcAACTsT | 596 | AD-9694 | | 52 | | | | |
| 1527-1545 | GCAGAGACUGAUCCACUUCTsT | 597 | GAAGUGGAUCAGUCUCUGCTsT | 598 | AD-9576 | | 47 | | | | |
| 1527-1545 | GcAGAGAcuGAuccAcuucTsT | 599 | GAAGUGGAucAGUCUCUGCTsT | 600 | AD-9702 | | 79 | | | | |
| 1529-1547 | AGAGACUGAUCCACUUCUCTsT | 601 | GAGAAGUGGAUCAGUCUCUTsT | 602 | AD-9627 | | 69 | | | | |
| 1529-1547 | AGAGAcuGAuccAcuucucTsT | 603 | GAGAAGUGGAucAGUCUCUTsT | 604 | AD-9753 | | 127 | | | | |
| 1543-1561 | UUCUCUGCCAAAGAUGUCATsT | 605 | UGACAUCUUUGGCAGAGAATsT | 606 | AD-9628 | | 141 | | | | |
| 1543-1561 | uucucuGccAAAGAuGucATsT | 607 | UGAcAUCUUUGGcAGAGAATsT | 608 | AD-9754 | | 89 | | | | |
| 1545-1563 | CUCUGCCAAAGAUGUCAUCTsT | 609 | GAUGACAUCUUUGGCAGAGTsT | 610 | AD-9631 | | 80 | | | | |
| 1545-1563 | cucuGccAAAGAuGucAucTsT | 611 | GAUGAcAUCUUUGGcAGAGTsT | 612 | AD-9757 | | 78 | | | | |
| 1580-1598 | CUGAGGACCAGCGGGUACUTsT | 613 | AGUACCCGCUGGUCCUCAGTsT | 614 | AD-9595 | | 31 | 32 | | | |
| 1580-1598 | cuGAGGAccAGcGGGuAcuTsT | 615 | AGuACCCGCUGGUCCUcAGTsT | 616 | AD-9721 | | 87 | 70 | | | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomologous monkey Hepatocyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 1581-1599 | UGAGGACCAGCGGGUACUGTsT | 617 | CAGUACCCGCUGGUCCUCATsT | 618 | AD-9544 | | 68 | | | | |
| 1581-1599 | uGAGGAccAGcGGGuACUGTsT | 619 | cAGuACCCGCUGGGCCUcATsT | 620 | AD-9670 | | 67 | | | | |
| 1666-1684 | ACUGUAUGGUCAGCACACUTT | 621 | AGUGUGCUGACCAUACAGUTT | 622 | AD-15235 | | | | 25 | | |
| 1668-1686 | UGUAGGUCAGCACACUCGTT | 623 | CGAGUGUGCCGACCAUACATT | 624 | AD-15236 | | | | 73 | | |
| 1669-1687 | GUAUGGUCAGCACACUCGGTT | 625 | CCGAGUGUGCUGACCAUACTT | 626 | AD-15168 | | | | 100 | | |
| 1697-1715 | GGAUGGCCACAGCCGUCGCTT | 627 | GCGACGGCUGUGGCCAUCCTT | 628 | AD-15174 | | | | 92 | | |
| 1698-1716 | GAUGGCCACAGCCGUCGCCTT | 629 | GGCGACGGCUGUGGCCAUCTT | 630 | AD-15235 | | | | 81 | | |
| 1806-1824 | CAAGCUGGUCUGCCGGGCCTT | 631 | GGCCCGGCAGACCAGCUUGTT | 632 | AD-15326 | | | | 65 | | |
| 1815-1833 | CUGCCCGGGCCCACAACCCUTsT | 633 | AGCGUGUGGGCCCGGCAGTsT | 634 | AD-9570 | 35 | 42 | | | | |
| 1815-1833 | cuGccCGGGcccAcAAcGcuTsT | 635 | AGCGUUGUGGGCCCGGCAGcuTsT | 636 | AD-9696 | | 77 | | | | |
| 1816-1834 | UGCCCGGGCCCACAACGCUUTsT | 637 | AAGCGUUGUGGGCCCGGCATsT | 638 | AD-9566 | | 38 | | | | |
| 1816-1834 | uGccCGGGcccAcAAcGcuuTsT | 639 | AAGCGUUGUGGGCCCGGCATsT | 640 | AD-9692 | | 78 | | | | |
| 1818-1836 | CCGGGCCCACAACGCUUUUTsT | 641 | AAAAGCGUUGUGGGCCCGGTsT | 642 | AD-9532 | | 100 | | | | |
| 1818-1836 | ccGGGcccAcAAcGccuuuTsT | 643 | AAAAGCGUUGUGGGCCCGGTsT | 644 | AD-9658 | | 102 | | | | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 1820-1838 | GCGGCCCACACGCUUUUGTsT | 645 | CCAAAAGCGUUGUGGGCCCTsT | 646 | AD-9549 | | 50 | | | | |
| 1820-1838 | GGGcccAcAAcGcuuuuGGTsT | 647 | CcAAAAGCGUUGUGGGCCCTsT | 648 | AD-9675 | | 78 | | | | |
| 1840-1858 | GGUGAGGGUGUCUACGCCATsT | 649 | UGGCGUAGACACCCUCACCTsT | 650 | AD-9541 | | 43 | | | | |
| 1840-1858 | GGuGAGGGuGucuAcGccATsT | 651 | UGGCGuAGAcACCCUcACCTsT | 652 | AD-9667 | | 73 | | | | |
| 1843-1861 | GAGGGUGUCUACGCCAUUGTsT | 653 | CAAUGGCGUAGACACCCUCTsT | 654 | AD-9550 | | 36 | | | | |
| 1843-1861 | GAGGGuGucuAcGccAuuGTsT | 655 | cAAUGGCGuAGAcACCCUCTsT | 656 | AD-9676 | | 100 | | | | |
| 1861-1879 | GCCAGGUGCUGCACCUGGCUACTsT | 657 | GUAGCCAGGUGCAGCACCUGGCTsT | 658 | AD-9571 | | 27 | 32 | | | |
| 1861-1879 | GccAGGuGcuGcAccUGcuAcTsT | 659 | GuAGCcAGGuGcAGcACCUGGCTsT | 660 | AD-9697 | | 74 | 89 | | | |
| 1862-1880 | CCAGGUGCUGCACCUGCUACCTsT | 661 | GGUAGCAGGCAGCACCUGGTsT | 662 | AD-9572 | 47 | 53 | | | | |
| 1862-1880 | ccAGGuGcuGcAccuGcuAccTsT | 663 | GGuAGcAGGcAGcACCUGTsT | 664 | AD-9698 | | 73 | | | | |
| 2008-2026 | ACCCACAAAGCCGCCUGUGCTT | 665 | GCACAGGCCGCUUGUGGGUUT | 666 | AD-15327 | | | | 82 | | |
| 2023-2041 | GUGCUGAGGCCACGAGGUCTsT | 667 | GACCUCGUGGCCUCAGCACTsT | 668 | AD-9639 | | 30 | 35 | | | |
| 2023-2041 | GuGcuGAGGccAcGAGGucTsT | 669 | GACCUCGUGGCCuCAGcACTsT | 670 | AD-9765 | | 82 | 74 | | | |
| 2024-2042 | UGCUGAGGCCACGAGGUCATsT | 671 | UGACCUCGUGGCCUCAGCATsT | 672 | AD-9518 | | 31 | 35 | | 0.60 | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 2024-2042 | UGCUGAGGCCACGAGGUCATsT | 673 | UGACCUCGUGGCCUCAGCATsT | 674 | AD-9518 | | 31 | | | | |
| 2024-2042 | uGcuGAGGccACGAGGucATsT | 675 | uGACCUCGUGGCCUcAGcATsT | 676 | AD-9644 | | 35 | 37 | | 2.60 | |
| 2024-2042 | UfgCfuGfaGfgCfCfAfcGfaGfgUfCAfTsT | 677 | p-aGfaCfCfUfcGfuGfgCfcUfcAfgCfaTsT | 678 | AD-14672 | | | | 26 | | |
| 2024-2042 | UfGCfUfGAGGCfCfAfCfGAGGUfCATsT | 679 | UfGACfCfUfCfCfGGCfCfUfCfAGCfATsT | 680 | AD-15682 | | | | 27 | | |
| 2024-2042 | UgCuGaGgCcAcGaGgUcATsT | 681 | p-uGfuCfcCfUfCfCfGfUfGGCfCfUfCfAGCfATsT | 682 | AD-14692 | | | | 22 | | |
| 2024-2042 | UgCuGaGgCcAcGuGgUcATsT | 683 | GfGACfCfUfCfCfGfUfGGCfCfUfCfAGCfATsT | 684 | AD-14702 | | | | 19 | | |
| 2024-2042 | UfgCfuGfaGfgCfCfAfcGfaGfgUfcAfTsT | 685 | UGACCfUugGCCUUCAgcaTsT | 686 | AD-14712 | | | | 25 | | |
| 2024-2042 | UfGCfUfGAGGCfCfAfCfGAGGUfCfATsT | 687 | UGACCucGUggCCUCAgcaTsT | 688 | AD-14722 | | | | 18 | | |
| 2024-2042 | UgCuGaGgCcAcGuGgUcATsT | 689 | UGACCucGUggCCUUCAgcaTsT | 690 | AD-14732 | | | | 32 | | |
| 2024-2042 | GfuGfGfuCfcAfgCfgCfgGfCfCfgGfgAfuGfTsT | 691 | p-cAfuCfcCfcCfGGcCfgCfgCfcGfaCfcAfcTsT | 692 | AD-15078 | | | | 86 | | |
| 2024-2042 | GUfGGUfCfAGCfAGCfGGCfCfCfGGGAUfGTsT | 693 | CfAUfCfCfCfGGCfCfGCfCfUfGACfGTACfTsT | 694 | AD-15088 | | | | 97 | | |
| 2024-2042 | GuGgUcAgCgCcGgGaUGTsT | 695 | p-cAfuCfcCfcCfGGcCfgCfuGfaCfcAfcTsT | 696 | AD-15098 | | | | 74 | | |
| 2024-2042 | GuGgUcAgCgCcGgGaUGTsT | 697 | CfAUfCfCfCfGGCfCfGCfCfUfGACfCfACfTsT | 698 | AD-15108 | | | | 67 | | |
| 2024-2042 | GfuGfGfuCfAfgCfgCfcCfgGfgAfuGfTsT | 699 | CAUCCcgGCcgCUGACcacTsT | 700 | AD-15118 | | | | 76 | | |

-continued

| position in human access. # NM_174936 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG2 [nM] | IC50 in Cynomolgous monkey Hepatacyte [nM]s |
|---|---|---|---|---|---|---|---|---|---|---|---|
| | | | | | | 100 nM/ HepG2 | 30 nM/ HepG2 | 3 nM/ HepG2 | 30 nM/ HeLa | | |
| 2024-2042 | GUfGUfCfAGfCfGGfCfCfGGGAUfGTsT | 701 | CAUCCggGCcgCUGACcacTsT | 702 | AD-15128 | | | | 86 | | |
| 2024-2042 | GuGgUcAgCgCGgCggAuGTsT | 703 | CAUCCggGCcgCUGACcacTsT | 704 | AD-15138 | | | | 74 | | |
| 2030-2048 | GGCCACGAGGUCAGCCCAATT | 705 | UCGGGCUGACCUCGUGGCCTT | 706 | AD-15237 | | | | 30 | | |
| 2035-2053 | CGAGGUCAGCCCAACCAGUTT | 707 | ACUGGUUGGGCUGACCUCGTT | 708 | AD-15287 | | | | 30 | | |
| 2039-2057 | GUCAGCCCAACCAGUGCGUTT | 709 | ACGCACUGGUUGGGCUGACTT | 710 | AD-15238 | | | | 36 | | |
| 2041-2059 | CAGCCCAACCAGUGCGUGGTT | 711 | CCACGCACUGGUUGGGCUGTT | 712 | AD-15238 | | | | 35 | | |
| 2062-2080 | CACAGGGAGGCCAGCAUCCTT | 713 | GGAUGCUGGCCUCCCUGUGTT | 714 | AD-15399 | | | | 47 | | |
| 2072-2090 | CCAGCAUCCACGCUUCCUGTsT | 715 | CAGGAAGCGUGGAUGCUGGTsT | 716 | AD-9582 | | 37 | | | | |
| 2072-2090 | cCAGcAUccAcGcucccuGTsT | 717 | cAGGAAGCGGGGAUGCUGGTsT | 718 | AD-9708 | | 81 | | | | |
| 2118-2136 | AGUcAAGGAGCAUGGAAUCTsT | 719 | GAUUCCAUGCUCCUUGACUTsT | 720 | AD-9545 | | 31 | 43 | | | |
| 2118-2136 | AGucAAGGAGcAUGGAAccTsT | 721 | GAUUCcAUGCUCCUUGACUTsT | 722 | AD-9671 | | 15 | 33 | | 2.50 | |
| 2118-2136 | AfGuUfcCfuUfgCfaCfuGfaCfuCTsT | 723 | p-gAfuUfcCfuUfgCfaCfuGfaCfuCfTsT | 724 | AD-14674 | | | | 16 | | |
| 2118-2136 | AGUfCfAAGGAGCfAUfGfGAAUfCfTsT | 725 | GAUfUfCfCfAUfGCfUfCfCfUfUfGfACfuUfTsT | 726 | AD-14684 | | | | 26 | | |
| 2118-2136 | AgUcAaGgAgCaUgGaAcCTsT | 727 | p-gAfuGfcfaUfgCfuCfuCfUfuGfuCfuTsT | 728 | AD-14694 | | | | 18 | | |

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatocyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 2118-2136 | AgUcAaGgAgCaUgGuAuCTsT | 729 | GAUfUfCfCfAUfGCfUfCfCfUfUfGACfUFTsT | 730 | AD-14704 | | | | 27 | | |
| 2118-2136 | AfgUfCAfUfGfGAfgCfAfUfgGgaAfcCfTsT | 731 | GAUUCcaUGcuCCUUGacuTsT | 732 | AD-14714 | | | | 20 | | |
| 2118-2136 | AGUfCfAAGGAGCfAUfGGAAUfCTTsT | 733 | GAUUCcaUGcUCCUUGucuTsT | 734 | AD-14724 | | | | 18 | | |
| 2118-2136 | AgUcAaGgAgCaUgGaAuCTsT | 735 | GAUUCcaUGcuCCUUGucuTsT | 736 | AD-14734 | | | | 18 | | |
| 2118-2136 | GfcGfgCfcUfcCfcUfaGfgCfcUfTsT | 737 | p-aGfgCfcUfaUfgAfgfgUfgCfcGfcTsT | 738 | AD-15080 | | | | 29 | | |
| 2118-2136 | GCfGGGCfACfCfCfUfCfAUfAGGGCfCfUfTsT | 739 | AGGCfCfGfCfAUfGAGGGUfGCfCfGfCfTsT | 740 | AD-15090 | | | | 23 | | |
| 2118-2136 | GcGgCaCcCfUaGgCCUTsT | 741 | p-aGfgCfcUfaUfgAfgfgUfgCfcGfcTsT | 742 | AD-15100 | | | | 26 | | |
| 2118-2136 | GcGgCaCcCfUaGgCcUTsT | 743 | AGGCfCfGfAUfGAGGGUfGCfCfCfCfTsT | 744 | AD-15110 | | | | 23 | | |
| 2118-2136 | GfcGfgCfaCfcCfcUfaGfgCfcUfTsT | 745 | AGGCCfuaUGagGGGUGCcgcTsT | 746 | AD-15120 | | | | 20 | | |
| 2118-2136 | GCfGGGCfACfCfCfUfCfAUfAGGCfCfUfTsT | 747 | AGGCCfuuUGugGGGUGCcgcTsT | 748 | AD-15130 | | | | 20 | | |
| 2118-2136 | GcGgCaCcCfUaGgCcUTsT | 749 | AGGCCfuaUGagGGGUGCcgcTsT | 750 | AD-15140 | | | | 19 | | |
| 2122-2140 | AAGGAGCAUGGAAUCCCGGTsT | 751 | CCGGGAUUCCAUGCUCCUUTsT | 752 | AD-9522 | | 59 | | | | |
| 2122-2140 | AAGGAGCAUgGAAUccCCGGTsT | 753 | CCGGGAUUCcAUGCUCCUUTsT | 754 | AD-9648 | | 78 | | | | |
| 2123-2141 | AGGAGCAUGGAAUCCCGCTsT | 755 | GCCGGGAUUCCAUGCUCCUTsT | 756 | AD-9552 | | 80 | | | | |

-continued

| position in human access. # NM_174936 | Sense strand sequence (5'-3')¹ | SEQ ID NO: | Antisense-strand sequence (5'-3')¹ | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 2123-2141 | AGGAGcAuGGAAucccGgcTsT | 757 | GCCGGGAUUCcAUGCUCCUTsT | 758 | AD-9678 | | 76 | | | | |
| 2125-2143 | GAGCAUGGAAUCCCGGCCCTsT | 759 | GGGCCGGGAUUCCAUGCUCTsT | 760 | AD-9618 | | 90 | | | | |
| 2125-2143 | GAGcAuGGAAucccGGcccTsT | 761 | GGGCCGGGAUUCcAUGCUCTsT | 762 | AD-9744 | | 91 | | | | |
| 2230-2248 | GCCUACGCCGUAGACAACATT | 763 | UGUUGUCUACGGCGUAGGCTT | 764 | AD-15239 | | | | 38 | | |
| 2231-2249 | CCCACGCCGUAGACAACACTT | 765 | GUGUUGUCUACGGCCGUAGGTT | 766 | AD-15212 | | | | 19 | | |
| 2232-2250 | CUACGCCGUAGACAACACGTT | 767 | CGUUGUCUACGGCGUAGTT | 768 | AD-15240 | | | | 43 | | |
| 2233-2251 | UACGCCGUAGACAACACGUTT | 769 | ACGUGUUGUCUACGGCGUATT | 770 | AD-15177 | | | | 59 | | |
| 2235-2253 | CGCCGUAGACAACACGUGUTT | 771 | ACACGUGUUGUCUACGGCGTT | 772 | AD-15179 | | | | 13 | | |
| 2236-2254 | GCCGUAGACAACACGUGUGTT | 773 | CACACGUGUUGUCUACGGCTT | 774 | AD-15180 | | | | 15 | | |
| 2237-2255 | CCGUAGACAACACGUGUGUTT | 775 | ACACACGUGUUGUCUACGGTT | 776 | AD-15241 | | | | 14 | | |
| 2238-2256 | CGUAGACAACACGUGUGUATT | 777 | UACACACGUGUUGUCUACGTT | 778 | AD-15268 | | | | 42 | | |
| 2240-2258 | UAGACAACACGUGUGUAGUTT | 779 | ACUACACACGUGUUGUCUATT | 780 | AD-15242 | | | | 21 | | |
| 2341-2259 | AGACAACACGUGUGUAGUCTT | 781 | GACUACACACGUGUUGUCUTT | 782 | AD-15216 | | | | 28 | | |
| 2242-2260 | GACAACACGUGUGUAGUCATT | 783 | UGACUACACACGUGUUGUCTT | 784 | AD-15176 | | | | 35 | | |

-continued

| position in human access. # NM_174936 | Sense strand sequence (5'-3')¹ | SEQ ID NO: | Antisense-strand sequence (5'-3')¹ | SEQ ID NO: | Duplex name | Mean percent remaining mRNA transcript at siRNA concentration/in cell type | | | | IC50 in HepG 2 [nM] | IC50 in Cynomolgous monkey Hepatocyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 2243-2261 | ACAAACGUGUGUAGUCAGTT | 785 | CUGACUACACACGUGUUGTT | 786 | AD-15181 | | | | 35 | | |
| 2244-2262 | CAACACGUGUGUAGUCAGGTT | 787 | CCUGACUACACACGUGUUGTT | 788 | AD-15243 | | | | 22 | | |
| 2247-2265 | CACGUGUGUAGUCAGGAGCTT | 789 | GCUCCUGACUACACACGUGTT | 790 | AD-15182 | | | | 42 | | |
| 2348-2266 | ACGUGUGUAGUCAGGAGCCTT | 791 | GGCUCCUGACUACACACGUTT | 792 | AD-15244 | | | | 31 | | |
| 2249-2267 | CGUGUGUAGUCAGGAGCCGTT | 793 | CGGCUCCUGACUACACACGTT | 794 | AD-15387 | | | | 23 | | |
| 2251-2269 | UGUGUAGUCAGGAGCCGGTT | 795 | CCCGGCUCCUGACUACACATT | 796 | AD-15245 | | | | 18 | | |
| 2257-2275 | GUCAGGAGCCGGGACGUCATsT | 797 | UGACGUCCCGGCUCCUGACTsT | 798 | AD-9555 | | 34 | | | | |
| 2257-2275 | GUcAGGAGccGGGAcGucATsT | 799 | UGACGUCCCGGCUCCUGACTsT | 800 | AD-9681 | | 55 | | | | |
| 2258-2276 | UCAGGAGCCGGGACGUCAGTsT | 801 | CUGACGUCCCGGCUCCUGATsT | 802 | AD-9619 | 42 | 61 | | | | |
| 2258-2276 | ucAGGAGccGGGAcGucAGTsT | 803 | CUGACGUCCCGGCUCCUGATsT | 804 | AD-9745 | | 56 | | | | |
| 2259-2277 | CAGGAGCCGGGACGUCAGCTsT | 805 | GCUGACGUCCCGGCUCCUGTsT | 806 | AD-9620 | 44 | 77 | | | | |
| 2259-2277 | cAGGAGccGGGAcGucAGCTsT | 807 | GCUGACGUCCCGGCUCCUGTsT | 808 | AD-9746 | | 89 | | | | |
| 2263-2281 | AGCCGGGACGUCAGCACUATT | 809 | UAGUGCUGACGUCCCGGCUTT | 810 | AD-15288 | | | | 19 | | |
| 2265-2283 | CCGGGACGUCAGCACUACATT | 811 | UGUAGUGCUGACGUCCCGGTT | 812 | AD-15246 | | | | 16 | | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 2303-2321 | CCGUGACAGCCGUUGCCAUTT | 813 | AUGGCAACGGCUGUCACGTT | 814 | AD-15289 | | | | 37 | | |
| 2317-2335 | GCCAUCUGCCGGAGCCTsT | 815 | GGCUCCGGCAGCAGAUGGCTsT | 816 | AD-9324 | | 59 | 67 | | | |
| 2375-2393 | CCCAUCCCAGGAUGGGUGUTT | 817 | ACACCCAUCCUGGGAUGGGTT | 818 | AD-15329 | | | | 103 | | |
| 2377-2395 | CAUCCCAGGAUGGGUGUCUTT | 819 | AGACACCCAUCCUGGGAUGTT | 820 | AD-15330 | | | | 62 | | |
| 2420-2438 | AGCUUUAAAAUGGUUCCGATT | 821 | UCGGAACCAUUUUAAAGCUTT | 822 | AD-15169 | | | | 22 | | |
| 2421-2439 | GCUUUAAAAUGGUUCCGACTT | 823 | GUCGGAACCAUUUUAAAGTT | 824 | AD-15201 | | | | 6 | | |
| 2422-2440 | CUUUAAAAUGGUUCCGACUTT | 825 | AGUCGGAACCAUUUUAAAGTT | 826 | AD-15331 | | | | 14 | | |
| 2423-2441 | UUUAAAAUGGUUCCGACUUTT | 827 | AAGUCGGAACCAUUUUAATT | 828 | AD-15190 | | | | 47 | | |
| 2424-2442 | UUAAAAUGGUUCCGACUUGTT | 829 | CAAGUCGGAACCAUUUUAATT | 830 | AD-15247 | | | | 61 | | |
| 2425-2443 | UAAAAUGGUUCCGACUUGUTT | 831 | ACAAGUCGGAACCAUUUUATT | 832 | AD-15248 | | | | 22 | | |
| 2426-2444 | AAAAUGGUUCCGACUUGUCTT | 833 | GACAAGUCGGAACCAUUUUTT | 834 | AD-15175 | | | | 45 | | |
| 2477-2445 | AAAUGGUUCCGACUUGUCCTT | 835 | GGACAAGUCGGAACCAUUUTT | 836 | AD-15249 | | | | 51 | | |
| 2428-2446 | AAUGGUUCCGACUUGUCCCTT | 837 | GGGACAAGUCGGAACCAUUTT | 838 | AD-15250 | | | | 96 | | |
| 2431-2449 | GGUUCCGACUGUUCCCUCUTT | 839 | AGAGGGACAAGUCGGAACCTT | 840 | AD-15400 | | | | 12 | | |

-continued

| position in human access. # NM_174936 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG2 [nM] | IC50 in Cynomologous monkey Hepatacyte [nM]s |
|---|---|---|---|---|---|---|---|---|---|---|---|
| | | | | | | 100 nM/ HepG2 | 30 nM/ HepG2 | 3 nM/ HepG2 | 30 nM/ HeLa | | |
| 2457-2475 | CUCCAUGGCCUGGCACGAGUU | 841 | CUCGUGCCAGGCCAUGGAGUU | 842 | AD-15332 | | | | 22 | | |
| 2459-2477 | CCAUGGCCUGGCACGAGGGUU | 843 | CCCUCGUGCCAGGCCAUGGUU | 844 | AD-15388 | | | 30 | | | |
| 2545-2563 | GAACUCACUCUCUGGGUU | 845 | ACCCAGAGUGAGUGAGUUCUU | 846 | AD-15333 | | | | 20 | | |
| 2549-2567 | UCACUCACUCUGGGUGCCUUU | 847 | AGGCACCCAGAGUGAGUGAUU | 848 | AD-15334 | | | | 96 | | |
| 2616-2634 | UUUCACCAUUCAAACAGGUU | 849 | ACCUGUUUGAAUGGUGAAAUU | 850 | AD-15335 | | | | 75 | | |
| 2622-2640 | CAUUCAAACAGUCGAGCUUU | 851 | AGCUCGACGUCUGUUUGAAUGUU | 852 | AD-15183 | | | | 16 | | |
| 2623-2641 | AUUCAAACAGGUCGAGCUGUU | 853 | CAGCUCGACCUGUUUGAAUUU | 854 | AD-15202 | | | | 41 | | |
| 2624-2642 | UCCAAACAGGUCGAGCUGUUU | 855 | ACAGCUCGACCUGUUUGAUU | 856 | AD-15203 | | | | 39 | | |
| 2625-2643 | UCAAACAGGUCGAGCUGUGUU | 857 | CACAGCUCGACCUGUUUGAUU | 858 | AD-15272 | | | | 49 | | |
| 2626-2644 | CAAACAGGUCGAGCUGUGCUU | 859 | GCACAGCUCGACCUGUUUGUU | 860 | AD-15217 | | | | 16 | | |
| 2627-2645 | AAACAGGUCGAGCUGUGCUUU | 861 | AGCACAGCUCGACCUGUUUUU | 862 | AD-15290 | | | | 15 | | |
| 2628-2646 | AACAGGUCGAGCUGUGCUCUU | 863 | GAGCACAGCUCGACCUGUUUU | 864 | AD-15218 | | | | 13 | | |
| 2630-2648 | CAGGUCGAGCUGUGCUCGUU | 865 | CCGAGCACAGCUCGACCUGUU | 866 | AD-15389 | | | | 13 | | |
| 2631-2649 | AGGUCGAGCUGUGCCCGGUU | 867 | CCCGAGCACAGCUCGACCUUU | 868 | AD-15336 | | | | 40 | | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomologous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 2633-2651 | GUCGAGCUGUGCUCGGUGUTT | 869 | CACCCGAGCACAGCUCGACUTT | 870 | AD-15337 | | | | 19 | | |
| 2634-2652 | UCGAGCUGUGCUCGGGUGCTT | 871 | GCACCCGAGCACAGCUCGAUTT | 872 | AD-15191 | | | | 33 | | |
| 2657-2675 | AGCUGCUCCCAUUGUGCCGUU | 873 | CGGCACAUUGGGAGCAGCUTT | 874 | AD-15390 | | | | 25 | | |
| 2658-2676 | GCUGCUCCCAUUGUGCCGATT | 875 | UCGGCACAUUGGGAGCAGCTT | 876 | AD-15338 | | | | 9 | | |
| 2660-2678 | UGCUCCCAAUUGUGCCGAUGTT | 877 | CAUCGGCACAUUGGGAGCATT | 878 | AD-15204 | | | | 33 | | |
| 2663-2681 | UCCCAAUGUGCCGAUGUCCTT | 879 | GGACAUCGGCACAUUGGGATT | 880 | AD-15251 | | | | 76 | | |
| 2665-2683 | CCAAUGUGCCGAUGUCCGUU | 881 | ACGGACAUCGGCACAUUGGTT | 882 | AD-15205 | | | | 14 | | |
| 2666-2684 | CAAUGUGCCGAUGUCCGUGTT | 883 | CACCGACAUCGGCACAUUGTT | 884 | AD-15171 | | | | 16 | | |
| 2667-2683 | AAUGUGCCGAUGUCCGUGGTT | 885 | CCACGGACAUCGGCACAUUTT | 886 | AD-15252 | | | | 58 | | |
| 2673-2691 | CCGAUGUCCGUGGGCAGAATT | 887 | UUCUGCCCACGGACAUCGGTT | 888 | AD-15339 | | | | 20 | | |
| 2675-2693 | GAUGUCCGUGGGCAGAAUGTT | 889 | CAUUCUGCCCACGGACAUCTT | 890 | AD-15253 | | | | 15 | | |
| 2678-2696 | GUCCGUGGGCAGAAUGACUTT | 891 | AGUCAUUCUGCCCACGGACTT | 892 | AD-15340 | | | | 18 | | |
| 2679-2697 | UCCGUGGGCAGAAUGACUUTT | 893 | AAGUCAUUCUGCCCACGGATT | 894 | AD-15291 | | | | 17 | | |
| 2683-2701 | UGGGCAGAAUGACUUUUAUTT | 895 | AUAAAAGUCAUUCUGCCCATT | 896 | AD-15341 | | | | 11 | | |

-continued

| position in human access. # NM_174936 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 2694-2712 | ACUUUAUUGAGCUCUUGUTT | 897 | ACAAGAGCUCAAUAAAGUTT | 898 | AD-15401 | | | | 13 | | |
| 2700-2718 | AUUGAGCUCUUGUUCCUGTT | 899 | CACGGAACAAGAGCUCAAUTT | 900 | AD-15342 | | | | 30 | | |
| 2704-2722 | AGCUCUUGUUCCGUGCAGTT | 901 | CUGGCACGGAACAAGAGAGCUTT | 902 | AD-15343 | | | | 21 | | |
| 2705-2723 | GCUCUUGUUCCGUGCAGGTT | 903 | CCUGGCACGGAACAAGAGCTT | 904 | AD-15292 | | | | 16 | | |
| 2710-2728 | UGUUCCGUGCCAGGCAUCTT | 905 | GAAUGCCUGGCACGGAACATT | 906 | AD-15344 | | | | 20 | | |
| 2711-2729 | GUUCCGUGCCAGGCAUUCTT | 907 | UGAAUGCCUGGCACGGAACTT | 908 | AD-15254 | | | | 18 | | |
| 2712-2730 | UUCCGUGCCAGGCAUUCAATT | 909 | UUGAAUGCCUGGCACGGAATT | 910 | AD-15345 | | | | 18 | | |
| 2715-2733 | CGUGCCAGGCAUUCAAUCCTT | 911 | GGAUUGAAUGCCUGGCACGTT | 912 | AD-15206 | | | | 15 | | |
| 2716-2734 | GUGCCAGGCAUUCAAUCCUTT | 913 | AGGAUUGAAUGCCUGGCACTT | 914 | AD-15346 | | | | 16 | | |
| 2728-2746 | CAAUCCUCAGGUCUCCCACCTT | 915 | GGUGGAGACCUGAGGAUUGTT | 916 | AD-15347 | | | | 62 | | |
| 2743-2761 | CACCAAGGAGGCAGGAUUCTsT | 917 | GAAUCCUGCCUCCUUGGUGTsT | 918 | AD-9577 | | 33 | 31 | | | |
| 2743-2761 | cAccAAGGAGGcAGGAuucTsT | 919 | GAAUCCUGCCUCCUUGGUGTsT | 920 | AD-9703 | | 17 | 26 | | | |
| 2743-2761 | CfaCfcAfaGfGfaGfGfcAfgGfaCfuCfTsT | 921 | p-gAfaUfcDfuGfcCfucfcUfuGfgUfgTsT | 922 | AD-14678 | | | | 22 | | |
| 2743-2761 | CfaCfcfaAGGAGGcfAGGAufCfcfTsT | 923 | GAAUfCfCfUfGfCfCfUfCfCfUfUfGGUfGTs T | 924 | AD-14688 | | | | 23 | | |

-continued

| position in human access. # NM_17493 6 | SEQ ID NO: | Sense strand sequence (5'-3')¹ | SEQ ID NO: | Antisense-strand sequence (5'-3')¹ | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 2743-2761 | 925 | CuCcAaGgAgGcAgGaUuCTsT | 926 | p-gAfaUfcCfuGfcCfuCfcUfuGfgUfgUfgTsT | AD-14698 | | | | 23 | | |
| 2743-2761 | 927 | CaCcAugGaGgCaGgUuCTsT | 928 | GAAUfcfCfgCfcCfUfcCfUfuFGTs T | AD-14708 | | | | 14 | | |
| 2743-2761 | 929 | CfaCfcAfaGfaGfAfgGfcAfgGfaUfuCfTsT | 930 | GAAUCcuGcGccUUCgcgTsT | AD-14718 | | | | 31 | | |
| 2743-2761 | 931 | CfAcfcfAAGGAGGCAGGAUfUfCfTsT | 932 | GAAUCcuGCccuUUGgcgTsT | AD-14728 | | | | 25 | | |
| 2743-2761 | 933 | CaCcAugGaGgCaGgaUuCTsT | 934 | GAAUCcuGCcUCCUUGgugTsT | AD-14738 | | | | 31 | | |
| 2743-2761 | 935 | GfgCfcUfGGfaGfuAfaUfuFcGfgAfTsT | 936 | p-uCfcGfaAfuAfaAfcUfcCfaGfgCfcTsT | AD-15084 | | | | 19 | | |
| 2743-2761 | 937 | GGCfcUfGGAGUfUfUfAUfUfCfGGATsT | 938 | UfcCfCfGAAUfAAACfuUfcCfAGGCfcTsT | AD-15094 | | | | 31 | | |
| 2743-2761 | 939 | GgCcUgGaGuUuAuUcGgATsT | 940 | p-a-CfcGfaAfuAfaAfcUfcCfuGfcCfcTsT | AD-15104 | | | | 16 | | |
| 2743-2761 | 941 | GgCcUgGaGuUuAuUcCgATsT | 942 | UfcCfCfGAAUfAAACfuUfcCfAGGCfcTsT | AD-15114 | | | | 15 | | |
| 2743-2761 | 943 | GfgCfcUfgGfaGfuUfuAfuUfcGfgAfTsT | 944 | UCCGaauAacUCCAGgCCTsT | AD-15124 | | | | 11 | | |
| 2743-2761 | 945 | CCCfCfUfGGAGUfUfUfAUfUfCfGGATsT | 946 | UCCGaauAacUCCAGgccTsT | AD-15134 | | | | 12 | | |
| 2743-2761 | 947 | GgCcUgGaGuUuAuUcGgATsT | 948 | UCCGaauAucUCCAGgccTsT | AD-15144 | | | | 9 | | |
| 2753-2771 | 949 | GCAGGAUUCUCCCAUGGATT | 950 | UCCAUGGGAAGAAUCCUGCTT | AD-15391 | | | | 7 | | |
| 2794-2812 | 951 | UGCAGGGACAAACAUCCUUTT | 952 | AACGAUGUUUGUCCCUGCATT | AD-15348 | | | | 13 | | |

-continued

| position in human access. # NM_174936 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 2795-2813 | GCAGGGACAAACAUCGUUGTT | 953 | CAACGAUGUUUGUCCCUGCTT | 954 | AD-15349 | | | | 8 | | |
| 2798-2815 | AGGGACAAACAUCGUUGGGTT | 955 | CCCAACGAUGUUUGUCCCUTT | 956 | AD-15170 | | | | 40 | | |
| 2841-2859 | CCCUCAUCUCCAGCUAACUTT | 957 | AGUUAGCUGGAGAUGAGGGTT | 958 | AD-15350 | | | | 14 | | |
| 2845-2863 | CAUCUCCAGCUAACUGUGGTT | 959 | CCACAGUUAGCUGGAGAUGTT | 960 | AD-15402 | | | | 27 | | |
| 2878-2896 | GCUCCCUGAUUAAUGGAGGTT | 961 | CCUCCAUUAAUCAGGGAGCTT | 962 | AD-15293 | | | | 27 | | |
| 2881-2899 | CCCUGAUUAAUGGAGGCUUTT | 963 | AAGCCGCCAUUAAUCAGGGTT | 964 | AD-15351 | | | | 14 | | |
| 2882-2900 | CCUGAUUAAUGGAGGCUUATT | 965 | UAAGCCUCCAUUAAUCAGGTT | 966 | AD-15403 | | | | 11 | | |
| 2884-2902 | UGAUUAAUGGAGGCUUAGCTT | 967 | GCUAAGCCUCCAUUAAUCATT | 968 | AD-15404 | | | | 38 | | |
| 2885-2903 | GAUUAAUGGAGGCUUAGCUTT | 969 | AGCUAAGCCUCCAUUAAUCTT | 970 | AD-15207 | | | | 15 | | |
| 2886-2904 | AUUAAUGGAGGCUUAGCUUTT | 971 | AAGCUAAGCCUCCAUUAAUTT | 972 | AD-15352 | | | | 23 | | |
| 2887-2905 | UUAAUGGAGGCUUAGCUUUTT | 973 | AAAGCUAAGCCUCCAUUAATT | 974 | AD-15255 | | | | 31 | | |
| 2903-2921 | UUUCUGGAUGCCAUCUAGCTsT | 975 | GCUAGAUGCCAUCCAGAAATsT | 976 | AD-9603 | | 123 | | | | |
| 2903-2921 | uuacuGGAuGCcAucuAGcTsT | 977 | GCuAGAUGCcAUcCAGAAATsT | 978 | AD-9729 | | 56 | | | | |
| 2904-2922 | UUCUGCAUGGCCAUCUAGCCTsT | 979 | GGCUAGAUGCCAUCCAGAUATsT | 980 | AD-9599 | | 139 | | | | |

-continued

| position in human access. # NM_174936 | Sense strand sequence (5'-3')¹ | SEQ ID NO: | Antisense-strand sequence (5'-3')¹ | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 2904-2922 | uucuGGAuGGcAucuAGccTsT | 981 | GGCuAGAUGCcAUCCAGAATsT | 982 | AD-9725 | | 38 | | | | |
| 2905-2923 | UCUGGAUGGCAUCUAGCCATsT | 983 | UGGCUAGAUGCCAUCCAGATsT | 984 | AD-9621 | | 77 | | | | |
| 2905-2923 | ucuGGAUGGcAucuAGcCATsT | 985 | UGGCuAGAUGCcAUCCAGATsT | 986 | AD-9747 | | 63 | | | | |
| 2925-2943 | AGGCUGGAGACAGGUGCGCTT | 987 | GCGCACCUGUCUCCAGCCUTT | 988 | AD-15405 | | | | 32 | | |
| 2926-2944 | GGCUGGAGACAGGUGCGCCTT | 989 | GGCGCACCUGUCUCCAGCCTT | 990 | AD-15353 | | | | 39 | | |
| 2927-2945 | GCUGGAGACAGGUGCGCCCTT | 991 | GGGCGCACCUGUCUCCAGCTT | 992 | AD-15354 | | | | 49 | | |
| 2972-2990 | UUCCUGAGCCACCUUUACUTT | 993 | AGUAAAGGUGGCUCAGGAATT | 994 | AD-15406 | | | | 35 | | |
| 2973-2991 | UCCUGAGCCACCUUUACUCTT | 995 | GAGUAAAGGUGGCUCAGGATT | 996 | AD-15407 | | | | 39 | | |
| 2974-2992 | CCUGAGCCACCUUUACUCUTT | 997 | AGAGUAAAGGUGGCUCAGGTT | 998 | AD-15355 | | | | 18 | | |
| 2976-2994 | UGAGCCACCUUUACUCUGCTT | 999 | GCAGAGUAAAGGUGGCUCATT | 1000 | AD-15356 | | | | 50 | | |
| 2978-2996 | AGCCACCUUUACUCUGCUCTT | 1001 | GAGCAGAGUAAAGGUGGCUTT | 1002 | AD-15357 | | | | 54 | | |
| 2981-2999 | CACCUUUACUCUGCUCUAUTT | 1003 | AUAGAGCAGAGUAAAGGUGTT | 1004 | AD-15269 | | | | 23 | | |
| 2987-3005 | UACUCUGCUCUAUGCCAGGTsT | 1005 | CCUGGCAUAGAGCAGAGUATsT | 1006 | AD-9565 | | 74 | | | | |
| 2987-3005 | uAcucuGcucuAuGccAGGTsT | 1007 | CCUGGcAuAGAGcAGAGuATsT | 1008 | AD-9691 | | 49 | | | | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 2998-3016 | AUGCCAGGCUGUGCUAGCAUU | 1009 | UGCUAGCACAGCCUGGCAUTT | 1010 | AD-15358 | | | | 12 | | |
| 303-3021 | AGGCUGUGCUAGCACACCUU | 1011 | GGUGUGCUAGCACAGCCUTT | 1012 | AD-15359 | | | | 24 | | |
| 3006-3024 | CUGUGCUAGCACAACCCAAUU | 1013 | UUGGGUUGUUGCUAGCACAGTT | 1014 | AD-15360 | | | | 13 | | |
| 3010-3028 | GCUAGCAACACCCAAAGGUU | 1015 | ACCUUUGGGUGUUGCUAGCTT | 1016 | AD-15219 | | | | 19 | | |
| 3038-3056 | GGAGCCAUCACCUAGGACUU | 1017 | AGUCCUAGGUGAUGGCUCCTT | 1018 | AD-15361 | | | | 24 | | |
| 3046-3064 | CACCUAGGACUGACUCGGCUU | 1019 | GCCGAGUCAGUCCUAGGUGTT | 1020 | AD-15273 | | | | 36 | | |
| 3051-3069 | AGGACUGACUCGGCAGUGUU | 1021 | ACACUGCCGAGUCAGUCCGTT | 1022 | AD-15362 | | | | 31 | | |
| 3052-3070 | GGACUGACUCGGCAGUGUGUU | 1023 | CACACUGCCGAGCCAGUCCTT | 1024 | AD-15192 | | | | 20 | | |
| 3074-3092 | UGGUGCAUGCACUGUCUCAUU | 1025 | UGAGACAGUGCAUGCACCATT | 1026 | AD-15256 | | | | 19 | | |
| 3080-3098 | AUGCACUGUCUCAGCCAACUU | 1027 | GUUGGCUGAGACAGUGCAUTT | 1028 | AD-15363 | | | | 33 | | |
| 3085-3103 | CUGUCUCAGCCAACCCGCUU | 1029 | AGCCGGUUGGCUGAGACAGTT | 1030 | AD-15364 | | | | 24 | | |
| 3089-3107 | CUCAGCCAACCCGCUCCACTsT | 1031 | GUGGAGCGGGUUGGCUGAGTsT | 1032 | AD-9604 | 35 | 49 | | | | |
| 3089-3107 | cucAGccAAcccGcuccAcTsT | 1033 | GUGGAGCGGGUUGGCUGAGTsT | 1034 | AD-9730 | | 85 | | | | |
| 3093-3111 | GCCAACCCGCUCCACUACCTsT | 1035 | GGUAGUGGAGCGGGUUGGCTsT | 1036 | AD-9527 | | 45 | | | | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomologous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 3093-3111 | GccAAccGcuccAcuAccTsT | 1037 | GGuAGuGGAGcGGuUuGGCTsT | 1038 | AD-9653 | | 86 | | | | |
| 3096-3114 | AACCCGCUCCACUACCCGGTT | 1039 | CCGGGuAGuGGAGCGGGUUTT | 1040 | AD-15365 | | | | 62 | | |
| 3099-3117 | CCGCUCCACUACCCGGCAGTT | 1041 | CUGCCGGGuAGuGGAGCGGTT | 1042 | AD-15294 | | | | 30 | | |
| 3107-3125 | CUACCCGGCAGGuACACATT | 1043 | UGUGuACCCUGCCGGGuAGTT | 1044 | AD-15173 | | | | 12 | | |
| 3108-3126 | UACCCGGCAGGuACACAUTT | 1045 | AUGUGuACCCUGCCGGGuATT | 1046 | AD-15366 | | | | 21 | | |
| 3109-3127 | ACCCGGCAGGuACACAUUTT | 1047 | AAUGUGuACCCUGCCGGGUTT | 1048 | AD-15367 | | | | 11 | | |
| 3110-3128 | CCCGGGCAGGuACACAUUCTT | 1049 | GAAUGUGuACCCUGCCGGGTT | 1050 | AD-15257 | | | | 18 | | |
| 3112-3139 | CGGCAGGuACACAUUCGCTT | 1051 | GCGAAUGUGuACCUGCCGTT | 1052 | AD-15184 | | | | 50 | | |
| 3114-3132 | GCAGGuACACAUUCGCACTT | 1053 | GUGCGAAUGUGuACCCUGCTT | 1054 | AD-15185 | | | | 12 | | |
| 3115-3133 | CAGGGuACACAUUCGCACCTT | 1055 | GGUGCGAAUGUGuACCCUGTT | 1056 | AD-15258 | | | | 73 | | |
| 3116-3134 | AGGGuACACAUUCGCACCCTT | 1057 | GGGUGCGAAUGUGuACCCUTT | 1058 | AD-15186 | | | | 36 | | |
| 3196-3214 | GGAACUGAGCCAGAAACGCTT | 1059 | GCGUUUCUGGCUCAGUUCCTT | 1060 | AD-15274 | | | | 19 | | |
| 3197-3215 | GAACUGAGCCAGAAACGCATT | 1061 | UGCGUUUCUGGCUCAGUUCTT | 1062 | AD-15368 | | | | 7 | | |
| 3198-3216 | AACUGAGCCAGAAACGCAGTT | 1063 | CUGCGUUUCUGGCUCAGUUTT | 1064 | AD-15369 | | | | 17 | | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 3201-3219 | UGACCCAGAAACGCAGAUTT | 1065 | AAUCUGCGUUUCUGGCUCATT | 1066 | AD-15370 | | | | 19 | | |
| 3207-3225 | AGAAACCCAGAUUGGGCUGTT | 1067 | CAGCCCAAUCUGGGUUUCUTT | 1068 | AD-15259 | | | | 38 | | |
| 3210-3228 | AACGCAGAUUGGGCUGGCUTT | 1069 | AGCCAGCCCAAUCUGCGUUTT | 1070 | AD-15408 | | | | 52 | | |
| 3233-3251 | AGCCAAGCCCUUCUUACUTsT | 1071 | AGUAAGAAGAGGCUUGGCUTsT | 1072 | AD-9597 | | 23 | 21 | | 0.04 | |
| 3233-3251 | AGccAAGcccucuucuuAcUTsT | 1073 | AGuAAGAAGAGGCUUGGCUTsT | | AD-9723 | | 12 | 26 | | | |
| 3233-3251 | AfgCfcAfuGfcCfcUfuCfuUfcUfuAfcUfTsT | 1075 | p-aGfuAfaGfaAfgAfgGfcUfuGfgCfuTsT | | AD-14680 | | | | 15 | | |
| 3233-3251 | AGCfCfAAGCfCfUfCfUfUfCfUfUfAfCfUfTsT | 1077 | AGUfAAGAAGAGGCfUfUfGGCfUfTsT | 1078 | AD-14690 | | | | 18 | | |
| 3233-3251 | AgCcAaGcCcUcUuAcUTsT | | AgfUfAaGfaAfgAfgGfcUfcGfgCfuTsT | 1079 | | | | | | | |
| 3233-3251 | AgCcAaGcCcUcUuAcUTsT | 1080 | AGUfAAGAAGAGGCfUfUfGfgCfuTsT | 1081 | AD-14700 | | | | 15 | | |
| 3233-3251 | AgCcAaGcCcUcUuAcUTsT | 1082 | AGUfAAGAAGAGGCfUfCfGGCfUfTsT | | AD-14710 | | | | 15 | | |
| 3233-3251 | AfgCfcAfuGfcCfcUfuCfuUfcUfuAfcUfTsT | 1083 | AGUAAGAaGagGCUUGgcuTsT | 1084 | AD-14720 | | | | 18 | | |
| 3233-3251 | AGCfCfAAGCfCfUfCfUfUfCfUfUfAfCfUfTsT | 1085 | AGUAAGAaGaGGGCUUGgcuTsT | 1086 | AD-14730 | | | | 18 | | |
| 3233-3251 | AgCcAaGcCcUcUuAcUTsT | 1087 | AGUAAGAaGagGCUUGgcaTsT | 1088 | AD-14740 | | | | 17 | | |
| 3233-3251 | UfgGfuUfcCfcUfgAfgGfaCfcAfgCfTsT | 1089 | p-gCfuGfgUfcCfcUfuGfgGfaAfcCfaTsT | 1090 | AD-15086 | | | | 85 | | |
| 3233-3251 | UfGGfUfCfCfCfUfGfAGGACfCfAGCfTsT | 1091 | GCfUfGGfUfCfCfCfUfCfAGGAACfCfATsT | 1092 | AD-15096 | | | | 70 | | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 3233-3251 | UgGuUcCcUgAgGaCcAgCTsT | 1093 | p-gCfugFGuFcCfuCfAgFgGfaAfcCfaTsT | 1094 | AD-15106 | | | | 71 | | |
| 3233-3251 | UgGuUcCcUgAgGuCcAgCTsT | 1095 | GCfUfGGufCfCfUfCfAGGGAACfCfATsT | 1096 | AD-15116 | | | | 73 | | |
| 3233-3251 | UfGgGfuUfcCfcUfAfgGfaCfcAfgCfTsT | 1097 | GCUGGucCUcuGGGAAccaTsT | 1098 | AD-15126 | | | | 71 | | |
| 3233-3251 | UfGGGfUfCfCfCfUfGAGGACfCfAGCfTsT | 1099 | GCUGGucCUcaGGGAAccaTsT | 1100 | AD-15136 | | | | 56 | | |
| 3233-3251 | UgGuUcCcUgAgGaCcAgCTsT | 1101 | GCUGGucCUcaGGGAAccaTsT | 1102 | AD-15146 | | | | 72 | | |
| 3242-3260 | UCUUCUUACUUCACCCGGCTT | 1103 | GCCGGGUGAAGUAAGAAGATT | 1104 | AD-15260 | | | | 79 | | |
| 3243-3261 | CUUCUUACUUCACCCGGCUTT | 1105 | AGCCGGGUGAAGUAAGAAGTT | 1106 | AD-15371 | | | | 24 | | |
| 3244-3262 | UCUUACUUCACCCGGCUGTT | 1107 | CAGCCGGGUGAAGUAAGAGATT | 1108 | AD-15372 | | | | 52 | | |
| 3262-3280 | GGGCUCCCAUUUUACGGGTT | 1109 | CCGUAAAAUGAGGAGCCCTT | 1110 | AD-15172 | | | | 27 | | |
| 3263-3281 | GGCUCCCAUUUUACGGGUTT | 1111 | CCCGUAAAAUGAGGAGCCTT | 1112 | AD-15295 | | | | 22 | | |
| 3264-3282 | GCUCCCAUUUUACGGGUTT | 1113 | ACCCGUAAAAUGAGGAGCTT | 1114 | AD-15373 | | | | 11 | | |
| 3263-3283 | CUCCCAUUUUACGGGUATT | 1115 | UACCCGUAAAAUGAGGAGTT | 1116 | AD-15163 | | | | 18 | | |
| 3266-3284 | UCCCAUUUUACGGGUAATT | 1117 | UUACCCGUAAAAUGAGGATT | 1118 | AD-15165 | | | | 13 | | |
| 3267-3285 | CCCAUUUUACGGGUAACTT | 1119 | GUUACCCGUAAAAUGAGGTT | 1120 | AD-15374 | | | | 23 | | |

| position in human access. # NM_174936 | SEQ ID NO: | Sense strand sequence (5'-3')¹ | SEQ ID NO: | Antisense-strand sequence (5'-3')¹ | Duplex name | 100 nM/ HepG 2 | 30 nM/ HepG 2 | 3 nM/ HepG 2 | 30 nM/ HeLa | IC50 in HepG 2 [nM] | IC50 in Cynomolgous monkey Hepatacyte [nM]s |
|---|---|---|---|---|---|---|---|---|---|---|---|
| 3268-3286 | 1121 | CUCAUUUUACGGGUAACAUU | 1122 | UGUUACCCGUAAAAUGAGUU | AD-15296 | | | | 13 | | |
| 3270-3288 | 1123 | CAUUUUACGGGUUAACAGUU | 1124 | ACUGUUACCCGUAAAAAUGUU | AD-15261 | | | | 20 | | |
| 3271-3289 | 1125 | AUUUUUACGGGUUAACAGUGUU | 1126 | CACUGUUACCCGUAAAAAUUU | AD-15375 | | | | 90 | | |
| 3274-3292 | 1127 | UUUACGGGUUAACAGUGAGUU | 1128 | CCCUCACUGUUACCCGUAAAUU | AD-15262 | | | | 72 | | |
| 3308-3326 | 1129 | CAGACCAGGAAGCUCGGUGUU | 1130 | CACCCGAGCUUCCUGGUCUGUU | AD-15376 | | | | 14 | | |
| 3310-3328 | 1131 | GACCAGGAAGCUCCGGUGAGUU | 1132 | CUCACCGAGCUUCCUGGUCUU | AD-15377 | | | | 19 | | |
| 3312-3330 | 1133 | CCAGGAAGCUCCGUGAGUGUU | 1134 | CACUCACCGAGCUUCCUGGUU | AD-15409 | | | | 17 | | |
| 3315-3333 | 1135 | GGAAGCUCGGUGAGUGAUGUU | 1136 | CAUCACUCACCGAGCUUCCUU | AD-15378 | | | | 18 | | |
| 3324-3342 | 1137 | GUGAGUGAUGGCAGAACGAUU | 1138 | UCGUUCUGCCAUCACUCACUU | AD-15410 | | | | 8 | | |
| 3326-3344 | 1139 | GAGUGAUGGCAGAACGAUGUU | 1140 | CAUCGUUCUGCCAUCACUCUU | AD-15379 | | | | 11 | | |
| 3330-3348 | 1141 | GAUGGCAGAACGAUGGCCUGUU | 1142 | CAGGCAUCGUUCUGCCAUCUU | AD-15187 | | | | 36 | | |
| 3336-3354 | 1143 | AGAACGAUGCCUGCAGGCAUU | 1144 | UGCCUGCAGGCAUCGUUCUUU | AD-15263 | | | | 18 | | |
| 3339-3357 | 1145 | ACGAUGCCUGCAGGCAUGGUU | 1146 | CCAUGCCUGCAGGCAUCGUUU | AD-15264 | | | | 75 | | |
| 3348-3366 | 1147 | GCAGGCAUGGAACUUUUUCUU | 1148 | GAAAAAGUUCCAUGCCUGCUU | AD-15297 | | | | 21 | | |

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 3356-3374 | GGAACUUUUCCGUUAUCAUT | 1148 | UGAUAACGGAAAAGUUCCTT | 1149 | AD-15208 | | | | 6 | | |
| 3357-3375 | GAACUUUUCCGUUAUCACUT | 1150 | GUGAGAACGGAAAAAGUUCTT | 1151 | AD-15209 | | | | 28 | | |
| 3358-3376 | AACUUUUCCGUUAUCCACUT | 1152 | GGUGAUAACGGAAAAAGUUTT | 1153 | AD-15193 | | | | 131 | | |
| 3370-3388 | UAUCACCCAGGCCUGAUUCUT | 1154 | GAAUCAGGCCUGGGUGAUATT | 1155 | AD-15380 | | | | 88 | | |
| 3378-3396 | AGGCCUGAUUCACUGGCCUT | 1156 | AGGCCAGUGAAUCAGGCCUTT | 1157 | AD-15298 | | | | 43 | | |
| 3383-3401 | UGAUUCACUGGCCUGGCGGT | 1158 | CCGCCAGGCCAGUGAAUCATT | 1159 | AD-15299 | | | | 99 | | |
| 3385-3403 | AUUCACUGGCCUGGCGGAGT | 1160 | CUCCGCCAGGCCAGUGAAUTT | 1161 | AD-15265 | | | | 95 | | |
| 3406-3424 | GCUUCUAAGGCAUGGUCGGT | 1162 | CCGACCAUGCCUUAGAAGCTT | 1163 | AD-15381 | | | | 18 | | |
| 3407-3425 | CUUCUAAGGCAUGGUCGGGT | 1164 | CCCGACCAUGCCUUAGAAGTT | 1165 | AD-15210 | | | | 40 | | |
| 3429-3447 | GAGGGGCCAACAACUGUCCCT | 1166 | GGGACAGUCGUUGGCCCCCTT | 1167 | AD-15270 | | | | 83 | | |
| 3440-3458 | ACUGUCCCUCCUUGAGCACTsT | 1168 | GUGCUCAAGGAGGGACAGUTsT | 1169 | AD-9591 | 75 | 95 | | | | |
| 3440-3458 | AcuGucccucccuuGAGcACTsT | 1170 | GUGCUcAAGGAGGGAcAGUTsT | 1171 | AD-9717 | | 105 | | | | |
| 3441-3459 | CUGUCCCUCCUUGAGCACUsT | 1172 | GGUGCUCAAGGAGGGACAGTsT | 1173 | AD-9622 | | 94 | | | | |
| 3441-3459 | cuGucccuucccuuGAGcAccTsT | 1174 | GGUGCUcAAGGAGGGAcAGTsT | 1175 | AD-9748 | | 103 | | | | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 3480-3498 | ACAUUAUCUUUUGGGUCUTsT | 1177 | AGACCAAAGAUAAAUGUTsT | 1178 | AD-9587 | | 63 | 49 | | | |
| 3480-3498 | AcAuuuAucuuuuGGGucuTsT | 1179 | AGACCcAAAAGAuAAAUGUTsT | 1180 | AD-9713 | | 22 | 25 | | | |
| 3480-3498 | AfcAfuUfuAfuCfuUfuUfgGfgUcUfTsT | 1181 | p-aGfuCfCfaAfaAfgAfuAfaAfuGfuTsT | 1182 | AD-14679 | | | | 19 | | |
| 3480-3498 | ACfAUfUfUfAfUfCfUfUfCfUfUfGGGUfcUfTsT | 1183 | AGACfCfCfAAAAGAUfAAAfGUTsT | 1184 | AD-14689 | | | | 24 | | |
| 3480-3498 | AcAuUuAuCaUuUgGgUcUTsT | 1185 | p-aGfaCfcCfaAfaAfgAfaUfaAfaAfuGfuTsT | 1186 | AD-14699 | | | | 19 | | |
| 3480-3498 | AcAuUuAuCcUuUgGgUcUTsT | 1187 | AGACfCfCfAAAAGAUfAAAfGUTsT | 1188 | AD-14709 | | | | 21 | | |
| 3480-3498 | AfcAfuUfuAfuDfuUfugGfgUfcUfTsT | 1189 | AGACCcaAAagAUAAAuguTsT | 1190 | AD-14719 | | | | 24 | | |
| 3480-3498 | ACfAUfUfUfAfUfCfUfUfCfUfUfGGGUfcUfTsTT | 1191 | AGACCCcaAAagAUAAAuguTsT | 1192 | AD-14729 | | | | 23 | | |
| 3480-3498 | AcAuUuAuCuUuUgGgUcUTsT | 1193 | AGACCcaAAagAUAAAuguTsT | 1194 | AD-14739 | | | | 24 | | |
| 3480-3498 | GfcCfaUfcCfgGfCfuGfcCfgGfaGfcCfTsT | 1195 | p-gGfcUfcCfgGfcCfaFgCfuGfaUfggCfcTsT | 1196 | AD-15085 | | | | 74 | | |
| 3480-3498 | GCfCfAUfCCfGfCfuGfCfCfGGAGCfCfTsT | 1197 | GGCfUfCfCfGGCfAGCfUAGAUfGGCfTsT | 1198 | AD-15095 | | | | 60 | | |
| 3480-3498 | GcCaUcGgCuGcCgGaGcCTsT | 1199 | p-gGfcUfcCfgGfcCfaFgCfuGfaUfggCfcTsT | 1200 | AD-15105 | | | | 33 | | |
| 3480-3498 | GcCaUcUgCuGuCgGaGcCTsT | 1201 | GGCfUfCfCfGGCfAGCfAGAUfGGCfTsT | 1202 | AD-15115 | | | | 30 | | |
| 3480-3498 | GfcCfaUfcCfgGfCfgGfaGfcCfTsT | 1203 | GGCUCauGcagCAGAUggcTsT | 1204 | AD-15125 | | | | 54 | | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 3480-3498 | GCfCfAUfCfUfGfCfUfGfCfCfGgAGCfcfTsT | 1205 | GGcGCauGcagCAGAUggcTsT | 1206 | AD-15135 | | | | 51 | | |
| 3480-3498 | GcCaUcUgCuGcCgGaGcCTsT | 1207 | GGCUCauGcagCAGAUggcTsT | 1208 | AD-15145 | | | | 49 | | |
| 3481-3499 | CAUUUaUCUUUUgGGGUCUGTsT | 1209 | CAGAcccAAAAagAuAAAUGTsT | 1210 | AD-9578 | 49 | 61 | | | | |
| 3481-3499 | cAuuuAucuuuuGGGuuuGTsT | 1211 | cAGACCcAAAAagAuAAAUGTsT | 1212 | AD-9704 | | 111 | | | | |
| 3485-3403 | UAUCUUUUgGGUCUGUCCUTsT | 1213 | AGGAcAGAcccAAAAagAUATsT | 1214 | AD-9558 | | 66 | | | | |
| 3485-3503 | uAucuuuuGGGucuGucccuTsT | 1215 | AGGAcAGAcccAAAAagAuATsT | 1216 | AD-9684 | | 63 | | | | |
| 3504-3522 | CUCUGUUGCCCUUUUAcAGTsT | 1217 | CUGUAAAAaGGcAACACAGAGTsT | 1218 | AD-9634 | | 29 | 30 | | | |
| 3504-3522 | cucuGuuGccuuuuuAcAGTsT | 1219 | CUGUAAAAaGGcAACAcAGAGTsT | 1220 | AD-9760 | | 14 | 27 | 5 | | |
| 3512-3530 | CCUUUUACAGCCAACUUUTT | 1221 | AAAGUUGGCUGUAAAAGGTT | 1222 | AD-15411 | | | | | | |
| 3521-3539 | AGCCAACUUUUUCUAGACCUTT | 1223 | AGGUCCAGAAAAGUUGGCUTT | 1224 | AD-15266 | | | | 23 | | |
| 3526-3544 | ACUUUUCUAGACCUGUUUTT | 1225 | AAAACAGGUCUAGAAAAGUTT | 1226 | AD-15382 | | | | 12 | | |
| 3530-3548 | UUCUAGACCUGUUUUGCUUTsT | 1227 | AAGCAAAAcAGGUCUAGATsT | 1228 | AD-9554 | | 23 | 24 | | | |
| 3530-3548 | uucuAGAccuGuuuuGcuuTsT | 1229 | AAGcAAAAcCGGUCuAGAATsT | 1230 | AD-9680 | | 12 | 22 | | 0.10 | |
| 3530-3548 | UfuCfuAfgAfccfuGfuUfuGfgCfuGfTsT | 1231 | p-aAfgCfaafacfcAfgGfuCfuAfgAfaTsT | 1232 | AD-14676 | | | | 12 | | 0.10 |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatocyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 3530-3548 | UfcFcfcfUfAGACfcfUfGfUfUfUfGCfUfUTTs T | 1233 | AAGTAAAACfAGGUfcfUfAGAATsT | 1234 | AD-14686 | | | | 13 | | |
| 3530-3548 | UuCuAgAcCuGcUuUgCuUTsT | 1235 | p-aAfgCfaaAfaAfcAfgGaCfcAfgAfaTsT | 1236 | AD-14696 | | | | 12 | | |
| 3530-3548 | UuCuAgAcCuGuUuUgCuUTsT | 1237 | AAGcfAAAACfAGGUfcfUfAGATsT | 1238 | AD-14706 | | | | 18 | | |
| 3530-3548 | UfcUfuAfgAfcCfuGfuUfaUfTCfuUTsT | 1239 | AAGcAaaAcAgGUCfUAgaaTsT | 1240 | AD-14716 | | | | 17 | | |
| 3530-3548 | UfUfCfUfAGACfcfUfGfUfUfUfGCfUfUTTs T | 1241 | AAGcCaaaAcAgGUCfUAgaaTsT | 1242 | AD-14726 | | | | 16 | | |
| 3530-3548 | UuCuAgAcCuGcUuUgCuUTsT | 1243 | AAGcAaaAcAgGUCfUAgaaTsT | 1244 | AD-14736 | | | | 9 | | |
| 3530-3548 | CfaUfaGfgCfcUfgGfaGfcUfaAfuCTTsT | 1245 | p-aAfuAfaAfcUfcCfaFfgCfcUfaUfgTsT | 1246 | AD-15082 | | | | 27 | | |
| 3530-3548 | CfAUfAGGCfcfUfGfGAGUfcfUfUTAUfGTsT | 1247 | AAUfAAAACfUfCfCfAGGCfcfUfUTAUfGTsT | 1248 | AD-15092 | | | | 28 | | |
| 3530-3548 | CaUaGgCcUgGaGuUuAuUTsT | 1249 | p-aAfcAfaAfcUfcCfaGfcCfuAfcfgTsT | 1250 | AD-15102 | | | | 19 | | |
| 3530-3548 | CfaUfaGfgCfcUfgGfaGfcUfuAfuUfTsT | 1251 | AAUfAAAACfUfCfCfAGGCfcfUfCTUfGTsT | 1252 | AD-15112 | | | | 17 | | |
| 3530-3548 | CfAUfAGGCfcfUfGfGAGUfcfUfUfACfUTTsT | 1253 | AAUfAAAacCCcaGGCfCUaugTsT | 1254 | AD-15122 | | | | 56 | | |
| 3530-3548 | CaUaGgCcUgGaGuUuAuUTsT | 1255 | AAUfAAucCCcaGGCfCUaugTsT | 1256 | AD-15132 | | | | 39 | | |
| 3530-3548 | CfAUfAGGCfcfUfGfGAGUfcfUfUfACfUTTsT | 1257 | AAUAAAacUCcaGGCfCCaugTsT | 1258 | AD-15142 | | | | 46 | | |
| 3531-3549 | UCUAGACCUUGUUUUGCUUUTsT | 1259 | AAAGCAAAACfAGGUfCUAGATsT | 1260 | AD-9553 | | 27 | 22 | | 0.02 | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatacyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 3531-3549 | ucuAGAccuGuuuuGccuuTsT | 1261 | AAAGcAAAAcAGGUCuAGATsT | 1262 | AD-9679 | | 17 | 21 | | | |
| 3531-3549 | UfcUfaGfacUfcUfgUfuUfuGfcUfcUfuUfTsT | 1263 | p-aAfaGfcAfaAfaCfaGfgUfcUfaGfaTsT | 1264 | AD-14675 | | | | 11 | | |
| 3531-3549 | UfcUfUfAGACfCfUfGfUfUfGfGfCfCfUfUfTs T | 1265 | AAAGfcAAAAfcAGGUfCfUfAGATsT | 1266 | AD-14685 | | | | 19 | | |
| 3531-3549 | UcUaGaCcUgUuUuGcUuUTsT | 1267 | p-AfaGfcAfaAfaCfaGfgUfcUfaGfaTsT | 1268 | AD-14695 | | | | 12 | | |
| 3531-3549 | UcUaGaCcUgUuUuGcUuUTsT | 1269 | AAAGfcAAAAfcAGGUfCfUfAGATsT | 1270 | AD-14705 | | | | 16 | | |
| 3531-3549 | UfcUfaGfacUfcUfgUfuUfuGfcUfaUfTsT | 1271 | AAAGcAaaAAcaGGUCuaGATsT | 1272 | AD-14715 | | | | 19 | | |
| 3531-3549 | UfcUfUfAGACfCfUfGfUfUfUfGfCfCfUfUfUfTs T | 1273 | AAAGcAaaAAcaGGUCuagaTsT | 1274 | AD-14725 | | | | 19 | | |
| 3531-3549 | UcUaGaCcUgUuUuGcUuUTsT | 1275 | AAAGcAaaAAcuGGUCuagaTsT | 1276 | AD-14735 | | | | 19 | | |
| 3531-3549 | UfcAfuAfgGfccfuGfaAfgUfuUfaUTTsT | 1277 | p-aUfaAfacfuCfcAfgGfccfuaAfuGfaTsT | 1278 | AD-15081 | | | | 30 | | |
| 3531-3549 | UfcfAfuAfGGCfCfUfGfAGUfUfAUfTsT | 1279 | AUfAAAfcUfCfCfAGGCfCfUfAUfGATsT | 1280 | AD-15091 | | | | 16 | | |
| 3531-3549 | UcAuAgGcCuGaGuUaUTsT | 1281 | p-aUfAAfacfuCfcAfgGfccfuAgcGfuTsT | 1282 | AD-15101 | | | | 16 | | |
| 3531-3549 | UcAuAgGcCuGaGuUaUTsT | 1283 | AUfAAAcFufCfCfuAGGCfCfUfUfAUfGATsT | 1284 | AD-15111 | | | | 11 | | |
| 3531-3549 | UfcAfuAfgGfccfuGfAfgfaUfAUfTsT | 1285 | AUAAAcuCcagGCCUAugaTsT | 1286 | AD-15121 | | | | 19 | | |
| 3531-3549 | UfcfAfuAfGGCfCfUfGfAGUfUfUfAUfTsT | 1287 | AUAAAcuCcagGCCUAugaTsT | 1288 | AD-15131 | | | | 17 | | |

-continued

| position in human access. # NM_17493 6 | Sense strand sequence (5'-3')[1] | SEQ ID NO: | Antisense-strand sequence (5'-3')[1] | SEQ ID NO: | Duplex name | Mean percent remaining mRNA transcript at siRNA concentration/in cell type | | | | IC50 in HepG 2 [nM] | IC50 in Cynomolgous monkey Hepatocyte [nM]s |
|---|---|---|---|---|---|---|---|---|---|---|---|
| | | | | | | 100 nM/ HepG 2 | 30 nM/ HepG 2 | 3 nM/ HepG 2 | 30 nM/ HeLa | | |
| 3531-3549 | UcAuAgGcCuGgAgUuUaUTsT | 1288 | AUAAAcuCCagGCCUAugaTsT | 1289 | AD-15141 | | | | 18 | | |
| 3557-3575 | UGAAGAUAUUUAGUCCCGGGTsT | 1290 | CCCAGAAUAAAUAUCUUCATsT | 1291 | AD-9626 | | 97 | 68 | | | |
| 3557-3575 | uGAAGAuAuuuAuuuuGGGTsT | 1292 | CCcAGAAuAAAuAUCUUcATsT | 1293 | AD-9752 | | 28 | 33 | | | |
| 3570-3588 | UCUGGGUUUUGUAGCAGUUTsT | 1294 | AAAUGCUACAAAACCCAGATsT | 1295 | AD-9629 | | 23 | 24 | | | |
| 3570-3588 | ucuGGGuuuuGuAGcAuuuTsT | 1296 | AAAUGCuACAAAACCcAGATsT | 1297 | AD-9755 | | 28 | 29 | | | |
| 3613-3631 | AUAAAACAAACAAACGUUTT | 1298 | AACGUUUGUUUGUUUUUAUTT | 1299 | AD-15412 | | | | 21 | | |
| 3677-3635 | AAACAAACAAACGUUGUCCTT | 1300 | GGACAACGUUUGUUUGUUUTT | 1301 | AD-15211 | | | | 73 | | |
| 3618-3636 | AACAAACAAACGUUGUCCUTT | 1302 | AGGACAACGUUUGUUUGUUTT | 1303 | AD-15300 | | | | 41 | | |

[1] U, C, A, G: corresponding ribonucleotide; T: deoxythymidine; u, c, a, g: corresponding 2'-O-methyl ribonucleotide; Uf, Cf, Af, Gf: corresponding 2'-deoxy-2'fluoro ribonucleotide; where nucleotides are written in sequence, they are connected by 3'-5' phosphodiester groups; nucleotides with interjected "s" are connected by 3'-O-5'-O phosphorothioester groups; unless denoted by prefix "p", oligonucleotides are devoid of a 5'-phosphate group on the 5'-most nucleotide; all oligonucleotides bear 3'-OH on the 3'-most nucleotide

TABLE 2

| Duplex number | Sense strand sequence (5'-3') | SEQ ID NO: | Antisense-strand sequence (5'-3') | SEQ ID NO: | Remaining mRNA in % of controls at siRNA conc. of 30 nM |
|---|---|---|---|---|---|
| AD-10792 | GccuGGAGuuuAuucGGATTsT | 1305 | UUCCAAuAAACUCcAGGCTsT | 1306 | 15 |
| AD-10793 | GccuGGAGuuuAuucGGAATsT | 1307 | uUcCGAAuAAACUCcAGGCTsT | 1308 | 32 |
| AD-10796 | GccuGGAGuuuAuucGGAATsT | 1309 | UUCCGAAUAAACUCCAGGCTsT | 1310 | 13 |
| AD-12038 | GccuGGAGuuuAuucGGAATsT | 1311 | uUCCGAAUAAACUCCAGGCTsT | 1312 | 13 |
| AD-12039 | GccuGGAGuuuAuucGGAATsT | 1313 | UuCCGAAUAAACUCCAGGCTsT | 1314 | 29 |
| AD-12040 | GccuGGAGuuuAuucGGAATsT | 1315 | UUcCGAAUAAACUCCAGGCTsT | 1316 | 10 |
| AD-12041 | GccuGGAGuuuAuucGGAATsT | 1317 | UUCcGAAUAAACUCCAGGCTsT | 1318 | 11 |
| AD-12042 | GCCUGGAGUUUAUUCGGAATsT | 1319 | uUCCGAAUAAACUCCAGGCTsT | 1320 | 12 |
| AD-12043 | GCCUGGAGUUUAUUCGGAATsT | 1321 | UuCCGAAUAAACUCCAGGCTsT | 1322 | 13 |
| AD-12044 | GCCUGGAGUUUAUUCGGAATsT | 1323 | UUcCGAAUAAACUCCAGGCTsT | 1324 | 7 |
| AD-12045 | GCCUGGAGUUUAUUCGGAATsT | 1325 | UUCcGAAUAAACUCCAGGCTsT | 1326 | 8 |
| AD-12046 | GccuGGAGuuuAuucGGAA | 1327 | UUCCGAAUAAACUCCAGGCscsu | 1328 | 13 |
| AD-12047 | GccuGGAGuuuAuucGGAAA | 1329 | UUUCCGAAUAAACUCCAGGCscsu | 1330 | 17 |
| AD-12048 | GccuGGAGuuuAuucGGAAAA | 1331 | UUUUCCGAAUAAACUCCAGGCscsu | 1332 | 43 |
| AD-12049 | GccuGGAGuuuAuucGGAAAAG | 1333 | CUUUUCCGAAUAAACUCCAGGCscsu | 1334 | 34 |
| AD-12050 | GccuGGAGuuuAuucGGAATTab | 1335 | UUCCGAAUAAACUCCAGGCTTab | 1336 | 16 |
| AD-12051 | GccuGGAGuuuAuucGGAAATTab | 1337 | UUUCCGAAuAAACUCCAGGCTTab | 1338 | 31 |
| AD-12052 | GccuGGAGuuuAuucGGAAAATTab | 1339 | UUUUCCGAAUAAACUCCAGGCTTab | 1340 | 81 |
| AD-12053 | GccuGGAGuuuAuucGGAAAAGTTab | 1341 | CUUUUCCGAAUAAACUCCAGGCTTab | 1342 | 46 |
| AD-12054 | GCCUGGAGUUUAUUCGGAATsT | 1343 | UUCCGAAUAAACUCCAGGCscsu | 1344 | 8 |
| AD-12055 | GccuGGAGuuuAuucGGAATsT | 1345 | UUCCGAAUAAACUCCAGGCscsu | 1346 | 13 |
| AD-12056 | GcCuGgAgUuUaUuCgGaA | 1347 | UUCCGAAUAAACUCCAGGCTTab | 1348 | 11 |
| AD-12057 | GcCuGgAgUuUaUuCgGaA | 1349 | UUCCGAAUAAACUCCAGGCTsT | 1350 | 8 |
| AD-12058 | GcCuGgAgUuUaUuCgGaA | 1351 | UUCCGAAuAAACUCcAGGCTsT | 1352 | 9 |
| AD-12059 | GcCuGgAgUuUaUuCgGaA | 1353 | uUcCGAAuAAACUcCAGGCTsT | 1354 | 23 |
| AD-12060 | GcCuGgAgUuUaUuCgGaA | 1355 | UUCCGaaUAaaCUCCAggc | 1356 | 10 |
| AD-12061 | GcCuGgnAgUuUaUuCgGaATsT | 1357 | UUCCGaaUAaaCUCCAggcTsT | 1358 | 7 |
| AD-12062 | GcCuGgAgUuUaUuCgGaATTab | 1359 | UUCCGaaUAaaCUCCAggcTTab | 1360 | 10 |
| AD-12063 | GcCuGgAgUuUaUuCgGaA | 1361 | UUCCGaaUAaaCUCCAggcscsa | 1362 | 19 |
| AD-12064 | GcCuGgnAgUuUaUuCgGaATsT | 1363 | UUCCGAAUAAACUCCAGGCTsT | 1364 | 15 |
| AD-12065 | GcCuGgAgUuUaUuCgGaATTab | 1365 | UUCCGAAuAAACUCcAGGCTTab | 1366 | 16 |
| AD-12066 | GcCuGgAgUuUaUuCgGaA | 1367 | UUCCGAAuAAACUCcAGGCscsu | 1368 | 20 |
| AD-12067 | GcCuGgnAgUuUaUuCgGaATsT | 1369 | UUCCGAAUAAACUCCAGGCTsT | 1370 | 17 |
| AD-12068 | GcCuGgAgUuUaUuCgGaATTab | 1371 | UUCCGAAUAAACUCCAGGCTTab | 1372 | 18 |
| AD-12069 | GcCuGgAgUuUaUuCgGaA | 1373 | UUCCGAAUAAACUCCAGGCscsu | 1374 | 13 |
| AD-12338 | GfcCfuGfgAfgUfuUfaUfuCfgGfaAf | 1375 | P-uUfcCfgAfaUfaAfaCfuCfcAfgGfc | 1376 | 15 |

TABLE 2-continued

| Duplex number | Sense strand sequence (5'-3') | SEQ ID NO: | Antisense-strand sequence (5'-3') | SEQ ID NO: | Remaining mRNA in % of controls at siRNA conc. of 30 nM |
|---|---|---|---|---|---|
| AD-12339 | GcCuGgAgUuUaUuCgGaA | 1377 | P-uUfcCfgAfaUfaAfaCfuCfcAfgGfc | 1378 | 14 |
| AD-12340 | GccuGGAGuuuAuucGGAA | 1379 | P-uUfcCfgAfaUfaAfaCfuCfcAfgGfc | 1380 | 19 |
| AD-12341 | GfcCfuGfgAfgUfuUfaUfuCfgGfaAfTsT | 1381 | P-uUfcCfgAfaUfaAfaCfuCfcAfgGfc TsT | 1382 | 12 |
| AD-12342 | GfcCfuGfgAfgUfuUfaUfuCfgGfaAfTsT | 1383 | UUCCGAAuAAACUCcAGGCTsT | 1384 | 13 |
| AD-12343 | GfcCfuGfgAfgUfuUfaUfuCfgGfaAfTsT | 1385 | uUcCGAAuAAACUccAGGCTsT | 1386 | 24 |
| AD-12344 | GfcCfuGfgAfgUfuUfaUfuCfgGfaAfTsT | 1387 | UUCCGAAUAAACUCCAGGCTsT | 1388 | 9 |
| AD-12345 | GfcCfuGfgAfgUfuUfaUfuCfgGfaAfTsT | 1389 | UUCCGAAUAAACUCCAGGCscsu | 1390 | 12 |
| AD-12346 | GfcCfuGfgAfgUfuUfaUfuCfgGfaAfTsT | 1391 | UUCCGaaUAaaCUCCAggcscsu | 1392 | 13 |
| AD-12347 | GCCUGGAGUUUAUUCGGAATsT | 1393 | P-uUfcCfgAfgaUfaAfaCfuCfcAfgGfc TsT | 1394 | 11 |
| AD-12348 | GccuGGAGuuuAuucGGAATsT | 1395 | P-uUfcCfgAfgaUfaAfaCfuCfcAfgGfc TsT | 1396 | 8 |
| AD-12349 | GcCuGgnAgUuUaUuCgGaATsT | 1397 | P-uUfcCfgAfgaUfaAfaCfuCfcAfgGfc TsT | 1398 | 11 |
| AD-12350 | GfcCfuGfgAfgUfuUfaUfuCfgGfaAfTTab | 1399 | P-uUfcCfgAfgaUfaAfaCfuCfcAfgGfc TTab | 1400 | 17 |
| AD-12351 | GfcCfuGfgAfgUfuUfaUfuCfgGfaAf | 1401 | P-uUfcCfgAfgaUfaAfaCfuCfcAfgGfcs Cfsu | 1402 | 11 |
| AD-12352 | GfcCfuGfgAfgUfuUfaUfuCfgGfaAf | 1403 | UUCCGaaUAaaCUCCAggcscsu | 1404 | 11 |
| AD-12354 | GfcCfuGfgAfgUfuUfaUfuCfgGfaAf | 1405 | UUCCGAAUAAACUCCAGGCscsu | 1406 | 11 |
| AD-12355 | GfcCfuGfgAfgUfuUfaUfuCfgGfaAf | 1407 | UUCCGAAuAAACUCcAGGCTsT | 1408 | 9 |
| AD-12356 | GfcCfuGfgAfgUfuUfaUfuCfgGfaAf | 1409 | uUcCGAAuAAACUccAGGCTsT | 1410 | 25 |
| AD-12357 | GmocCmouGmogAm02gUmouUmoaUmouCmogGmoaA | 1411 | UUCCGaaUAaaCUCCAggc | 1412 | 56 |
| AD-12358 | GmocCmouGmogAm02gUmouUmoaUmouCmogGmoaA | 1413 | P-uUfcCfgAfaUfaAfaCfuCfcAfgGfc | 1414 | 29 |
| AD-12359 | GmocCmouGmogAm02gUmouUmoaUmouCmogGmoaA | 1415 | P-uUfcCfgAfaUfaAfaCfuCfcAfgGfcs Cfsu | 1416 | 30 |
| AD-12360 | GmocCmouGmogAm02gUmouUmoaUmouCmogGmoaA | 1417 | UUCCGAAUAAACUCCAGGCscsu | 1418 | 15 |
| AD-12361 | GmocCmouGmogAm02gUmouUmoaUmouCmogGmoaA | 1419 | UUCCGAAuAAACUCcAGGCTsT | 1420 | 20 |
| AD-12362 | GmocCmouGmogAm02gUmouUmoaUmouCmogGmoaA | 1421 | uUcCGAAuAAACUccAGGCTsT | 1422 | 51 |
| AD-12365 | GmocCmouGmogAm02gUmouUmoaUmouCmogGmoaA | 1423 | UUCCGaaUAaaCUCCAggcscsu | 1424 | 11 |
| AD-12364 | GmocCmouGmogAmogUmouUmoaUmonCmogGmonATsT | 1425 | UUCCGaaUAaaCUCCAggcTsT | 1426 | 25 |
| AD-12365 | GmocCmouGmogAmogUmouUmoaUmouCmogGmonATsT | 1427 | UUCCGAAuAAACUCcAGGCTsT | 1428 | 18 |
| AD-12366 | GmocCmouGmogAmogUmouUmoaUmouCmogGmonATsT | 1429 | UUCCGAAUAAACUCCAGGCTsT | 1430 | 23 |
| AD-12367 | GmocmocmouGGAGmoumoumouAmoumoumocGGAATsT | 1431 | UUCCGaaUAaaCUCCAggcTsT | 1432 | 42 |
| AD-12368 | GmocmocmouGGAGmoumoumonAmoumoumocGGAATsT | 1433 | UUCCGAAuAAACUCcAGGCTsT | 1434 | 40 |
| AD-12369 | GmocmocmouGGAGmoumoumouAmoumoumocGGAATsT | 1435 | UUCCGAAUAAACUCCAGGCTsT | 1436 | 26 |
| AD-12370 | GmocmocmouGGAGmoumoumouAmoumoumocGGAATsT | 1437 | P-UfUfCfCfgAAUfAAACfUfCfCfAGGCf TsT | 1438 | 68 |
| AD-12371 | GmocmocmouGGAGmoumoumouAmoumoumocGGAATsT | 1439 | P-UfUfCfCfgAAUfAAACfUfCfCfAGGCfs CfsUf | 1440 | 60 |

TABLE 2-continued

| Duplex number | Sense strand sequence (5'-3') | SEQ ID NO: | Antisense-strand sequence (5'-3') | SEQ ID NO: | Remaining mRNA in % of controls at siRNA conc. of 30 nM |
|---|---|---|---|---|---|
| AD-12372 | GmocmocmouGGAGmoumoumonAmoumoumocGGAATsT | 1441 | P-uUfcCfgAfaUfaAfaCfuCfcAfgGfcsCfsu | 1442 | 60 |
| AD-12373 | GmocmocmouGGAGmoumoumouAmoumoumocGGAATsT | 1443 | UUCCGAAUAAACUCCAGGCTsT | 1444 | 55 |
| AD-12374 | GCfCfUfGGAGUfUfUfAUfUfCfGGAATsT | 1445 | UfUfCfCfGAAUfAAACfUfCfCfAGGCfTsT | 1446 | 9 |
| AD-12375 | GCfCfUfGGAGUfUfUfAUfUfCfGGAATsT | 1447 | UUCCGAAUAAACUCCAGGCTsT | 1448 | 16 |
| AD-12377 | GCfCfUfGGAGUfUfUfAUfUfCfGGAATsT | 1449 | uUcCGAAuAAACUccAGGCTsT | 1450 | 88 |
| AD-12378 | GCfCfUfGGAGUfUfUfAUfUfCfGGAATsT | 1451 | UUCCGaaUAaaCUCCAggcscsu | 1452 | 6 |
| AD-12379 | GCfCfUfGGAGUfUfUfAUfUfCfGGAATsT | 1453 | UUCCGAAUAAACUCCAGGCscsu | 1454 | 6 |
| AD-12380 | GCfCfUfGGAGUfUfUfAUfUfCfGGAATsT | 1455 | P-uUfcCfgAfaUfaAfaCfuCfcAfgGfcsCfsu | 1456 | 8 |
| AD-12381 | GCfCfUfGGAGUfUfUfAUfUfCfGGAATsT | 1457 | P-uUfcCfgAfaUfaAfaCfuCfcAfgGfcTsT | 1458 | 10 |
| AD-12382 | GCfCfUfGGAGUfUfUfAUfUfCfGGAATsT | 1459 | P-UfUfCfCfGAAUfAAACfUfCfCfAGGCfTsT | 1460 | 7 |
| AD-12383 | GCCUGGAGUUUAUUCGGAATsT | 1461 | P-UfUfCfCfGAAUfAAACfUfCfCfAGGCfTsT | 1462 | 7 |
| AD-12384 | GCcuGGAGuuuAuucGGAATsT | 1463 | P-UfUfCfCfGAAUfAAACfUfCfCfAGGCfTsT | 1464 | 8 |
| AD-12385 | GcCuGgnAgUuUaUuCgGaATsT | 1465 | P-UfUfCfCfGAAUfAAACfUfCfCfAGGCfTsT | 146 | 8 |
| AD-12386 | GfcCfuGfgAfgUfuUfaUfuCfuGfaAf | 1467 | P-UfUfCfCfGAAUfAAACfUfCfCfAGGCfTsT | 1468 | 11 |
| AD-12387 | GCfCfUfGGAGGUfUfUfAUfUfCfGGAA | 1469 | UfUfCfCfGAAUfAAACfUfCfCfAGGCfsCfsUf | 1470 | 13 |
| AD-12388 | GCfCfUfGGAGGUfUfUfAUfUfCfGGAA | 1471 | P-uUfcCfgAfaUfaAfaCfuCfcAfgGfc | 1472 | 19 |
| AD-12389 | GCfCfUfGGAGGUfUfUfAUfUfCfGGAA | 1473 | P-uUfcCfgAfaUfaAfaCfuCfcAfgGfcsCfsu | 1474 | 16 |
| AD-12390 | GCfCfUfGGAGGUfUfUfAUfUfCfGGAA | 1475 | UUCCGAAUAAACUCCAGGCscsu | 1476 | 17 |
| AD-12391 | GCfCfUfGGAGGUfUfUfAUfUfCfGGAA | 1477 | UUCCGaaUAaaCUCCAggc | 1478 | 21 |
| AD-12392 | GCfCfUfGGAGGUfUfUfAUfUfCfGGAA | 1479 | UUCCGAAUAAACUCCAGGCTsT | 1480 | 28 |
| AD-12393 | GCfCfUfGGAGGUfUfUfAUfUfCfGGAA | 1481 | UUCCGAAuAAACUCcAGGCTsT | 1482 | 17 |
| AD-12394 | GCfCfUfGGAGGUfUfUfAUfUfCfGGAA | 1483 | uUcCGAAuAAACUccAGGCTsT | 1484 | 75 |
| AD-12395 | GmocCmouGmogAmogUmouUmoaUmouCmogGmoaATsT | 1485 | P-UfUfCfCfGAAUfAAACfUfCfCfAGGCfsCfsUf | 1486 | 55 |
| AD-12396 | GmocCmouGmogAmo2gUmouUmoaUmouCmogGmoaA | 1487 | P-UfUfCfCfGAAUfAAACfUfCfCfAGGCfsCfsUf | 1488 | 59 |
| AD-12397 | GfcCfuGfgAfgUfuUfaUfuCfgGfaAf | 1489 | P-UfUfCfCfGAAUfAAACfUfCfCfAGGCfsCfsUf | 1490 | 20 |
| AD-12398 | GfcCfuGfgAfgUfuUfaUfuCfgGfaAfTsT | 1491 | P-UfUfCfCfGAAUfAAACfUfCfCfAGGCfsCfsUf | 1492 | 11 |
| AD-12399 | GcCuGgnAgUuUaUuCgGaATsT | 1493 | P-UfUfCfCfGAAUfAAACfUfCfCfAGGCfsCfsUf | 1494 | 13 |
| AD-12400 | GCCUGGAGUUUAUUCGGAATsT | 1495 | P-UfUfCfCfGAAUfAAACfUfCfCfAGGCfsCfsUf | 1496 | 12 |

TABLE 2-continued

| Duplex number | Sense strand sequence (5'-3') | SEQ ID NO: | Antisense-strand sequence (5'-3') | SEQ ID NO: | Remaining mRNA in % of controls at siRNA conc. of 30 nM |
|---|---|---|---|---|---|
| AD-12401 | GccuGGAGuuuAuucGGAATsT | 1497 | P-UfUfCfCfGAAUfAAACfUfCfCfAGGCfs CfsUf | 1498 | 13 |
| AD-12402 | GccuGGAGuuuAuucGGAA | 1499 | P-UfUfCfCfGAAUfAAACfUfCfCfAGGCfs CfsUf | 1500 | 14 |
| AD-12403 | GCfCfUfGGAGGUfUfUfAUfUfCfGGAA | 1501 | P-UfUfCfCfGAAUfAAACfUfCfCfAGGCfs CfsUf | 1502 | 4 |
| AD-9314 | GCCUGGAGUUUAUUCGGAATsT | 1503 | UUCCGAAUAAACUCCAGGCTsT | 1504 | 9 |

[1]U, C, A, G: corresponding ribonucleotide; T: deoxythymidine; u, c, a, g: corresponding 2'-O-methyl ribonucleotide; Uf, Cf, Af, Gf: corresponding 2'-deoxy-2'-fluoro ribonucleotide; moc, mou, mog, moa: corresponding 2'-MOE nucleotide; where nucleotides are written in sequence, they are connected by 3'-5' phosphodiester groups; ab: 3'-terminal abasic nucleotide; nucleotides with interjected "s" are connected by 3'-O-5'-O phosphorothiodiestergroups; unless denoted by prefix "p-", oligonucleotides are devoid of a 5'-phosphate group on the 5'-most nucleotide; all oligonucleotides bear 3'-OH on the 3'-most nucleotide

SEQUENCE LISTING (1505 sequences)

SEQ ID NO: 1 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
agcgacgucgaggcgcucatt

SEQ ID NO: 2 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ugagcgccucgacgucgcutt

SEQ ID NO: 3 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cgcucaugguugcaggcggtt

SEQ ID NO: 4 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ccgccugcaaccaugagcgtt

SEQ ID NO: 5 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gcucaugguugcaggcgggtt

SEQ ID NO: 6 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cccgccugcaaccaugagctt

SEQ ID NO: 7 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gcgggcgccgccguucagutt

SEQ ID NO: 8 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
acugaacggcggcgcccgctt

SEQ ID NO: 9 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cgggcgccgccguucaguutt

SEQ ID NO: 10 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
aacugaacggcggcgcccgtt

SEQ ID NO: 11 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gggcgccgccguucaguuctt

SEQ ID NO: 12 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gaacugaacggcggcgccctt

SEQ ID NO: 13 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ccguucaguucagggucugtt

SEQ ID NO: 14 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cagacccugaacugaacggtt

SEQ ID NO: 15 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
uucaguucagggucugagctt

SEQ ID NO: 16 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gcucagacccugaacugaatt

SEQ ID NO: 17 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gugagacuggcucgggcggtt

SEQ ID NO: 18 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ccgcccgagccagucucactt

SEQ ID NO: 19 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ggccgggacgcgucguugctt

SEQ ID NO: 20 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gcaacgacgcgucccggcctt

SEQ ID NO: 21 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gccgggacgcgucguugcatt

SEQ ID NO: 22 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ugcaacgacgcgucccggctt

SEQ ID NO: 23 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ccgggacgcgucguugcagtt

SEQ ID NO: 24 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cugcaacgacgcgucccggtt

SEQ ID NO: 25 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ggacgcgucguugcagcagtt

SEQ ID NO: 26 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cugcugcaacgacgcgucctt

SEQ ID NO: 27 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
ucccagccaggauuccgcgtt

SEQ ID NO: 28 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
cgcggaauccuggcugggatt

SEQ ID NO: 29 - DNA, 21 bp, Artificial sequence
  siRNAs to PCSK9
  5'-terminal nucleic acid is a nucleoside, i.e. base + sugar but lacking 5'-phosphate
  modified_base 1, 2, 3, 4, 7, 8, 13, 14, 15, 16, 18: /mod_base = "2'-O-methyl corresponding base"
  modified_base 21: /mod_base = "5'-thio thymidine"
  modified_base 5, 6, 9, 10, 11, 12, 17, 19: /mod_base = "2'-hydroxy corresponding base"
ucccagccaggauuccgcgtt

SEQ ID NO: 30 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
cgcggaauccuggcugggatt

SEQ ID NO: 31 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
cccagccaggauuccgcgctt

SEQ ID NO: 32 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gcgcggaauccuggcugggtt

SEQ ID NO: 33 - DNA, 21 bp, Artificial sequence
  siRNAs to PCSK9
  5'-terminal nucleic acid is a nucleoside, i.e. base + sugar but lacking 5'-phosphate
  modified_base 1, 2, 3, 6, 7, 12, 13, 14, 15, 17, 19: /mod_base = "2'-O-methyl corresponding base"
  modified_base 21: /mod_base = "5'-thio thymidine"
  modified_base 4, 5, 8, 9, 10, 11, 16, 18: /mod_base = "2'-hydroxy corresponding base"
cccagccaggauuccgcgctt

SEQ ID NO: 34 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gcgcggaauccuggcugggtt

SEQ ID NO: 35 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
cagccaggauuccgcgcgctt

SEQ ID NO: 36 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gcgcgcggaauccuggcugtt

SEQ ID NO: 37 - DNA, 21 bp, Artificial sequence
  siRNAs to PCSK9
  5'-terminal nucleic acid is a nucleoside, i.e. base + sugar but lacking 5'-phosphate
  modified_base 1, 4, 5, 10, 11, 12, 13, 15, 17, 19: /mod_base = "2'-O-methyl corresponding base"
  modified_base 21: /mod_base = "5'-thio thymidine"
  modified_base 2, 3, 6, 7, 8, 9, 14, 16, 18: /mod_base = "2'-hydroxy corresponding base"
cagccaggauuccgcgcgctt

SEQ ID NO: 38 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gcgcgcggaauccuggcugtt

SEQ ID NO: 39 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
agcuccugcacaguccucctt

SEQ ID NO: 40 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
ggaggacugugcaggagcutt

SEQ ID NO: 41 - DNA, 21 bp, Artificial sequence
  siRNAs to PCSK9
  5'-terminal nucleic acid is a nucleoside, i.e. base + sugar but lacking 5'-phosphate
  modified_base 3, 4, 5, 6, 7, 9, 11, 14, 15, 16, 17, 18, 19: /mod_base = "2'-O-methyl corresponding base"
  modified_base 21: /mod_base = "5'-thio thymidine"
  modified_base 1, 2, 8, 10, 12, 13: /mod_base = "2'-hydroxy corresponding base"
agcuccugcacaguccucctt

SEQ ID NO: 42 - DNA, 21 bp, Artificial sequence
  siRNAs to PCSK9
  5'-terminal nucleic acid is a nucleoside, i.e. base + sugar but lacking 5'-phosphate
  modified_base 12: /mod_base = "2'-O-methyl corresponding base"
  modified_base 21: /mod_base = "5'-thio thymidine"
  modified_base 1, 2, 3, 4, 5, 6, 7, 8, 9, 10, 11, 13, 14, 15, 16, 17, 18, 19: /mod_base = "2'-hydroxy corresponding base"
ggaggacugugcaggagcutt

SEQ ID NO: 43 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
caccgcaaggcucaaggcgtt

SEQ ID NO: 44 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cgccuugagccuugcggugtt

SEQ ID NO: 45 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cgcaaggcucaaggcgccgtt

SEQ ID NO: 46 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cggcgccuugagccuugcgtt

SEQ ID NO: 47 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
caaggcucaaggcgccgcctt

SEQ ID NO: 48 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ggcggcgccuugagccuugtt

SEQ ID NO: 49 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
guggaccgcgcacggccuctt

SEQ ID NO: 50 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gaggccgugcgcgguccactt

SEQ ID NO: 51 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
uggaccgcgcacggccucutt

SEQ ID NO: 52 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
agaggccgugcgcgguccatt

SEQ ID NO: 53 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ggaccgcgcacggccucuatt

SEQ ID NO: 54 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
uagaggccgugcgcggucctt

SEQ ID NO: 55 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gaccgcgcacggccucuagtt

SEQ ID NO: 56 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cuagaggccgugcgcgguctt

SEQ ID NO: 57 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
accgcgcacggccucuaggtt

SEQ ID NO: 58 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ccuagaggccgugcgcggutt

SEQ ID NO: 59 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ccgcgcacggccucuaggutt

SEQ ID NO: 60 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
accuagaggccgugcgcggtt

SEQ ID NO: 61 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cgcgcacggccucuagguctt

SEQ ID NO: 62 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gaccuagaggccgugcgcgtt

SEQ ID NO: 63 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gcgcacggccucuaggucutt

SEQ ID NO: 64 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
agaccuagaggccgugcgctt

SEQ ID NO: 65 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cgcacggccucuaggucuctt

SEQ ID NO: 66 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gagaccuagaggccgugcgtt

SEQ ID NO: 67 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cucuaggucuccucgccagtt

SEQ ID NO: 68 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cuggcgaggagaccuagagtt

SEQ ID NO: 69 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ucuaggucuccucgccaggtt

SEQ ID NO: 70 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ccuggcgaggagaccuagatt

SEQ ID NO: 71 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cuaggucuccucgccaggatt

SEQ ID NO: 72 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
uccuggcgaggagaccuagtt

SEQ ID NO: 73 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
aggucuccucgccaggacatt

SEQ ID NO: 74 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
uguccuggcgaggagaccutt

SEQ ID NO: 75 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ccucgccaggacagcaacctt

SEQ ID NO: 76 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gguugcuguccuggcgaggtt

SEQ ID NO: 77 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
cgucagcuccaggcggucctt

SEQ ID NO: 78 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
ggaccgccuggagcugacgtt

SEQ ID NO: 79 - DNA, 21 bp, Artificial sequence
  siRNAs to PCSK9
  5'-terminal nucleic acid is a nucleoside, i.e. base + sugar but lacking 5'-phosphate
  modified_base 1, 3, 4, 7, 8, 9, 10, 14, 17, 18, 19: /mod_base = "2'-O-methyl corresponding base"
  modified_base 21: /mod_base = "5'-thio thymidine"
  modified_base 2, 5, 6, 11, 12, 13, 15, 16: /mod_base = "2'-hydroxy corresponding base"
cgucagcuccaggcggucctt

SEQ ID NO: 80 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
ggaccgccuggagcugacgtt

SEQ ID NO: 81 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gucagcuccaggcgguccutt

SEQ ID NO: 82 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
aggaccgccuggagcugactt

SEQ ID NO: 83 - DNA, 21 bp, Artificial sequence
  siRNAs to PCSK9
  5'-terminal nucleic acid is a nucleoside, i.e. base + sugar but lacking 5'-phosphate
  modified_base 2, 3, 6, 7, 8, 9, 13, 16, 17, 18, 19: /mod_base = "2'-O-methyl corresponding base"
  modified_base 21: /mod_base = "5'-thio thymidine"
  modified_base 1, 4, 5, 10, 11, 12, 14, 15: /mod_base = "2'-hydroxy corresponding base"
gucagcuccaggcgguccutt

SEQ ID NO: 84 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
aggaccgccuggagcugactt

SEQ ID NO: 85 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ggcgcccgugcgcaggaggtt

SEQ ID NO: 86 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ccuccugcgcacgggcgcctt

SEQ ID NO: 87 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
ggagcuggugcuagccuugtt

SEQ ID NO: 88 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
caaggcuagcaccagcucctt

SEQ ID NO: 89 - DNA, 21 bp, Artificial sequence
  siRNAs to PCSK9
  5'-terminal nucleic acid is a nucleoside, i.e. base + sugar but lacking 5'-phosphate
  modified_base 5, 6, 9, 11, 12, 15, 16, 17, 18: /mod_base = "2'-O-methyl corresponding base"
  modified_base 21: /mod_base = "5'-thio thymidine"
  modified_base 1, 2, 3, 4, 7, 8, 10, 13, 14, 19: /mod_base = "2'-hydroxy corresponding base"
ggagcuggugcuagccuugtt

SEQ ID NO: 90 - DNA, 21 bp, Artificial sequence
  siRNAs to PCSK9
  5'-terminal nucleic acid is a nucleoside, i.e. base + sugar but lacking 5'-phosphate
  modified_base 1, 7, 10, 13: /mod_base = "2'-O-methyl corresponding base"
  modified_base 21: /mod_base = "5'-thio thymidine"
  modified_base 2, 3, 4, 5, 6, 8, 9, 11, 12, 14, 15, 16, 17, 18, 19: /mod_base = "2'-hydroxy corresponding base"
caaggcuagcaccagcucctt

SEQ ID NO: 91 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gcuggugcuagccuugcgutt

SEQ ID NO: 92 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
acgcaaggcuagcaccagctt

SEQ ID NO: 93 - DNA, 21 bp, Artificial sequence
  siRNAs to PCSK9
  5'-terminal nucleic acid is a nucleoside, i.e. base + sugar but lacking 5'-phosphate
  modified_base 2, 3, 6, 8, 9, 12, 13, 14, 15, 17, 19: /mod_base = "2'-O-methyl corresponding base"
  modified_base 21: /mod_base = "5'-thio thymidine"
  modified_base 1, 4, 5, 7, 10, 11, 16, 18: /mod_base = "2'-hydroxy corresponding base"
gcuggugcuagccuugcgutt

SEQ ID NO: 94 - DNA, 21 bp, Artificial sequence
  siRNAs to PCSK9
  5'-terminal nucleic acid is a nucleoside, i.e. base + sugar but lacking 5'-phosphate
  modified_base 4, 10, 13, 16: /mod_base = "2'-O-methyl corresponding base"
  modified_base 21: /mod_base = "5'-thio thymidine"
  modified_base 1, 2, 3, 5, 6, 7, 8, 9, 11, 12, 14, 15, 17, 18, 19: /mod_base = "2'-hydroxy corresponding base"
acgcaaggcuagcaccagctt

SEQ ID NO: 95 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
cuggugcuagccuugcguutt

SEQ ID NO: 96 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
aacgcaaggcuagcaccagtt

SEQ ID NO: 97 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
cuggugcuagccuugcguutt

SEQ ID NO: 98 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
aacgcaaggcuagcaccagtt

SEQ ID NO: 99 - DNA, 21 bp, Artificial sequence
  siRNAs to PCSK9
  5'-terminal nucleic acid is a nucleoside, i.e. base + sugar but lacking 5'-phosphate
  modified_base 1, 2, 5, 7, 8, 11, 12, 13, 14, 16, 18, 19: /mod_base = "2'-O-methyl corresponding base"
  modified_base 21: /mod_base = "5'-thio thymidine"
  modified_base 3, 4, 6, 9, 10, 15, 17: /mod_base = "2'-hydroxy corresponding base"
cuggugcuagccuugcguutt

SEQ ID NO: 100 - DNA, 21 bp, Artificial sequence
  siRNAs to PCSK9
  5'-terminal nucleic acid is a nucleoside, i.e. base + sugar but lacking 5'-phosphate
  modified_base 5, 11, 14, 17: /mod_base = "2'-O-methyl corresponding base"
  modified_base 21: /mod_base = "5'-thio thymidine"
  modified_base 1, 2, 3, 4, 6, 7, 8, 9, 10, 12, 13, 15, 16, 18, 19: /mod_base = "2'-hydroxy corresponding base"
aacgcaaggcuagcaccagtt

SEQ ID NO: 101 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
ugcuagccuugcguuccgatt

SEQ ID NO: 102 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
ucggaacgcaaggcuagcatt

SEQ ID NO: 103 - DNA, 21 bp, Artificial sequence
  siRNAs to PCSK9
  5'-terminal nucleic acid is a nucleoside, i.e. base + sugar but lacking 5'-phosphate
  modified_base 1, 3, 4, 7, 8, 9, 10, 12, 14, 15, 16, 17: /mod_base = "2'-O-methyl corresponding base"
  modified_base 21: /mod_base = "5'-thio thymidine"
  modified_base 2, 5, 6, 11, 13, 18, 19: /mod_base = "2'-hydroxy corresponding base"
ugcuagccuugcguuccgatt

SEQ ID NO: 104 - DNA, 21 bp, Artificial sequence
  siRNAs to PCSK9
  5'-terminal nucleic acid is a nucleoside, i.e. base + sugar but lacking 5'-phosphate
  modified_base 9, 15, 18: /mod_base = "2'-O-methyl corresponding base"
  modified_base 21: /mod_base = "5'-thio thymidine"
  modified_base 1, 2, 3, 4, 5, 6, 7, 8, 10, 11, 12, 13, 14, 16, 17, 19: /mod_base = "2'-hydroxy corresponding base"
ucggaacgcaaggcuagcatt

SEQ ID NO: 105 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
uagccuugcguuccgaggatt

SEQ ID NO: 106 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
uccucggaacgcaaggcuatt

SEQ ID NO: 107 - DNA, 21 bp, Artificial sequence
  siRNAs to PCSK9
  5'-terminal nucleic acid is a nucleoside, i.e. base + sugar but lacking 5'-phosphate
  modified_base 1, 4, 5, 6, 7, 9, 11, 12, 13, 14: /mod_base = "2'-O-methyl corresponding base"
  modified_base 21: /mod_base = "5'-thio thymidine"
  modified_base 2, 3, 8, 10, 15, 16, 17, 18, 19: /mod_base = "2'-hydroxy corresponding base"
uagccuugcguuccgaggatt

SEQ ID NO: 108 - DNA, 21 bp, Artificial sequence
  siRNAs to PCSK9
  5'-terminal nucleic acid is a nucleoside, i.e. base + sugar but lacking 5'-phosphate
  modified_base 12, 18: /mod_base = "2'-O-methyl corresponding base"
  modified_base 21: /mod_base = "5'-thio thymidine"
  modified_base 1, 2, 3, 4, 5, 6, 7, 8, 9, 10, 11, 13, 14, 15, 16, 17, 19: /mod_base = "2'-hydroxy corresponding base"
uccucggaacgcaaggcuatt

SEQ ID NO: 109 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gacggccuggccgaagcactt

SEQ ID NO: 110 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gugcuucggccaggccguctt

SEQ ID NO: 111 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ggccgaagcacccgagcactt

SEQ ID NO: 112 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gugcucgggugcuucggcctt

SEQ ID NO: 113 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gccgaagcacccgagcacgtt

SEQ ID NO: 114 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cgugcucgggugcuucggctt

SEQ ID NO: 115 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ccgaagcacccgagcacggtt

SEQ ID NO: 116 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ccgugcucgggugcuucggtt

SEQ ID NO: 117 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ccgagcacggaaccacagctt

SEQ ID NO: 118 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gcugugguuccgugcucggtt

SEQ ID NO: 119 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
caccgcugcgccaaggauctt

SEQ ID NO: 120 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gauccuuggcgcagcggugtt

SEQ ID NO: 121 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ccgcugcgccaaggauccgtt

SEQ ID NO: 122 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cggauccuuggcgcagcggtt

SEQ ID NO: 123 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cgcugcgccaaggauccgutt

SEQ ID NO: 124 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
acggauccuuggcgcagcgtt

SEQ ID NO: 125 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cugcgccaaggauccguggtt

SEQ ID NO: 126 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ccacggauccuuggcgcagtt

SEQ ID NO: 127 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
auccguggagguugccuggtt

SEQ ID NO: 128 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ccaggcaaccuccacggautt

SEQ ID NO: 129 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gguugccuggcaccuacgutt

SEQ ID NO: 130 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
acguaggugccaggcaacctt

SEQ ID NO: 131 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
aggagacccaccucucgcatt

SEQ ID NO: 132 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ugcgagaggugggucuccutt

SEQ ID NO: 133 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ggagacccaccucucgcagtt

SEQ ID NO: 134 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cugcgagaggugggucucctt

SEQ ID NO: 135 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gagacccaccucucgcagutt

SEQ ID NO: 136 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
acugcgagaggugggucuctt

SEQ ID NO: 137 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ccaccucucgcagucagagtt

SEQ ID NO: 138 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cucugacugcgagagguggtt

SEQ ID NO: 139 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ccucucgcagucagagcgctt

SEQ ID NO: 140 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gcgcucugacugcgagaggtt

SEQ ID NO: 141 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cucucgcagucagagcgcatt

SEQ ID NO: 142 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ugcgcucugacugcgagagtt

SEQ ID NO: 143 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ucucgcagucagagcgcactt

SEQ ID NO: 144 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gugcgcucugacugcgagatt

SEQ ID NO: 145 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
cucgcagucagagcgcacutt

SEQ ID NO: 146 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
agugcgcucugacugcgagtt

SEQ ID NO: 147 - DNA, 21 bp, Artificial sequence
  siRNAs to PCSK9
  5'-terminal nucleic acid is a nucleoside, i.e. base + sugar but lacking 5'-phosphate
  modified_base 1, 2, 3, 5, 8, 9, 14, 16, 18, 19: /mod_base = "2'-O-methyl corresponding base"
  modified_base 21: /mod_base = "5'-thio thymidine"
  modified_base 4, 6, 7, 10, 11, 12, 13, 15, 17: /mod_base = "2'-hydroxy corresponding base"
cucgcagucagagcgcacutt

SEQ ID NO: 148 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
agugcgcucugacugcgagtt

SEQ ID NO: 149 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gcagucagagcgcacugcctt

SEQ ID NO: 150 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
ggcagugcgcucugacugctt

SEQ ID NO: 151 - DNA, 21 bp, Artificial sequence
  siRNAs to PCSK9
  5'-terminal nucleic acid is a nucleoside, i.e. base + sugar but lacking 5'-phosphate
  modified_base 2, 5, 6, 11, 13, 15, 16, 18, 19: /mod_base = "2'-O-methyl corresponding base"
  modified_base 21: /mod_base = "5'-thio thymidine"
  modified_base 1, 3, 4, 7, 8, 9, 10, 12, 14, 17: /mod_base = "2'-hydroxy corresponding base"
gcagucagagcgcacugcctt

SEQ ID NO: 152 - DNA, 21 bp, Artificial sequence
  siRNAs to PCSK9
  5'-terminal nucleic acid is a nucleoside, i.e. base + sugar but lacking 5'-phosphate
  modified_base 3: /mod_base = "2'-O-methyl corresponding base"
  modified_base 21: /mod_base = "5'-thio thymidine"
  modified_base 1, 2, 4, 5, 6, 7, 8, 9, 10, 11, 12, 13, 14, 15, 16, 17, 18, 19: /mod_base = "2'-hydroxy corresponding base"
ggcagugcgcucugacugctt

SEQ ID NO: 153 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gggauaccucaccaagauctt

SEQ ID NO: 154 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gaucuuggugagguauccctt

SEQ ID NO: 155 - DNA, 21 bp, Artificial sequence
  siRNAs to PCSK9
  5'-terminal nucleic acid is a nucleoside, i.e. base + sugar but lacking 5'-phosphate
  modified_base 5, 7, 8, 9, 10, 12, 13, 18, 19: /mod_base = "2'-O-methyl corresponding base"
  modified_base 21: /mod_base = "5'-thio thymidine"
  modified_base 1, 2, 3, 4, 6, 11, 14, 15, 16, 17: /mod_base = "2'-hydroxy corresponding base"
gggauaccucaccaagauctt

SEQ ID NO: 156 - DNA, 21 bp, Artificial sequence
  siRNAs to PCSK9
  5'-terminal nucleic acid is a nucleoside, i.e. base + sugar but lacking 5'-phosphate
  modified_base 14: /mod_base = "2'-O-methyl corresponding base"
  modified_base 21: /mod_base = "5'-thio thymidine"
  modified_base 1, 2, 3, 4, 5, 6, 7, 8, 9, 10, 11, 12, 13, 15, 16, 17, 18, 19: /mod_base = "2'-hydroxy corresponding base"
gaucuuggugagguauccctt

SEQ ID NO: 157 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
uggugaagaugaguggcgatt

SEQ ID NO: 158 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
ucgccacucaucuucaccatt

SEQ ID NO: 159 - DNA, 21 bp, Artificial sequence
  siRNAs to PCSK9
  5'-terminal nucleic acid is a nucleoside, i.e. base + sugar but lacking 5'-phosphate
  modified_base 1, 4, 10, 14, 17: /mod_base = "2'-O-methyl corresponding base"
  modified_base 21: /mod_base = "5'-thio thymidine"
  modified_base 2, 3, 5, 6, 7, 8, 9, 11, 12, 13, 15, 16, 18, 19: /mod_base = "2'-hydroxy corresponding base"
uggugaagaugaguggcgatt

SEQ ID NO: 160 - DNA, 21 bp, Artificial sequence
  siRNAs to PCSK9
  5'-terminal nucleic acid is a nucleoside, i.e. base + sugar but lacking 5'-phosphate
  modified_base 5, 9, 15, 18: /mod_base = "2'-O-methyl corresponding base"
  modified_base 21: /mod_base = "5'-thio thymidine"
  modified_base 1, 2, 3, 4, 6, 7, 8, 10, 11, 12, 13, 14, 16, 17, 19: /mod_base = "2'-hydroxy corresponding base"
ucgccacucaucuucaccatt

SEQ ID NO: 161 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gaagaugaguggcgaccugtt

SEQ ID NO: 162 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
caggucgccacucaucuuctt

SEQ ID NO: 163 - DNA, 21 bp, Artificial sequence
  siRNAs to PCSK9
  5'-terminal nucleic acid is a nucleoside, i.e. base + sugar but lacking 5'-phosphate
  modified_base 6, 10, 13, 16, 17, 18: /mod_base = "2'-O-methyl corresponding base"
  modified_base 21: /mod_base = "5'-thio thymidine"
  modified_base 1, 2, 3, 4, 5, 7, 8, 9, 11, 12, 14, 15, 19: /mod_base = "2'-hydroxy corresponding base"
gaagaugaguggcgaccugtt

SEQ ID NO: 164 - DNA, 21 bp, Artificial sequence
  siRNAs to PCSK9
  5'-terminal nucleic acid is a nucleoside, i.e. base + sugar but lacking 5'-phosphate
  modified_base 1, 9, 13: /mod_base = "2'-O-methyl corresponding base"
  modified_base 21: /mod_base = "5'-thio thymidine"
  modified_base 2, 3, 4, 5, 6, 7, 8, 10, 11, 12, 14, 15, 16, 17, 18, 19: /mod_base = "2'-hydroxy corresponding base"
caggucgccacucaucuuctt

SEQ ID NO: 165 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
cccaugucgacuacaucgatt

SEQ ID NO: 166 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
ucgauguagucgacaugggtt

SEQ ID NO: 167 - DNA, 21 bp, Artificial sequence
  siRNAs to PCSK9
  5'-terminal nucleic acid is a nucleoside, i.e. base + sugar but lacking 5'-phosphate
  modified_base 1, 2, 3, 5, 7, 8, 11, 12, 14, 16, 17: /mod_base = "2'-O-methyl corresponding base"
  modified_base 21: /mod_base = "5'-thio thymidine"
  modified_base 4, 6, 9, 10, 13, 15, 18, 19: /mod_base = "2'-hydroxy corresponding base"
cccaugucgacuacaucgatt

SEQ ID NO: 168 - DNA, 21 bp, Artificial sequence
  siRNAs to PCSK9
  5'-terminal nucleic acid is a nucleoside, i.e. base + sugar but lacking 5'-phosphate
  modified_base 7, 14: /mod_base = "2'-O-methyl corresponding base"
  modified_base 21: /mod_base = "5'-thio thymidine"
  modified_base 1, 2, 3, 4, 5, 6, 8, 9, 10, 11, 12, 13, 15, 16, 17, 18, 19: /mod_base = "2'-hydroxy corresponding base"
ucgauguagucgacaugggtt

SEQ ID NO: 169 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
aucgaggaggacuccucugtt

SEQ ID NO: 170 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
cagaggaguccuccucgautt

SEQ ID NO: 171 - DNA, 21 bp, Artificial sequence
  siRNAs to PCSK9
  5'-terminal nucleic acid is a nucleoside, i.e. base + sugar but lacking 5'-phosphate
  modified_base 2, 3, 12, 13, 14, 15, 16, 17, 18: /mod_base = "2'-O-methyl corresponding base"
  modified_base 21: /mod_base = "5'-thio thymidine"
  modified_base 1, 4, 5, 6, 7, 8, 9, 10, 11, 19: /mod_base = "2'-hydroxy corresponding base"
aucgaggaggacuccucugtt

SEQ ID NO: 172 - DNA, 21 bp, Artificial sequence
  siRNAs to PCSK9
  5'-terminal nucleic acid is a nucleoside, i.e. base + sugar but lacking 5'-phosphate
  modified_base 1: /mod_base = "2'-O-methyl corresponding base"
  modified_base 21: /mod_base = "5'-thio thymidine"
  modified_base 2..19: /mod_base = "2'-hydroxy corresponding base"
cagaggaguccuccucgautt

SEQ ID NO: 173 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ggaaccuggagcggauuactt

SEQ ID NO: 174 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
guaauccgcuccagguucctt

SEQ ID NO: 175 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gaaccuggagcggauuacctt

SEQ ID NO: 176 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
gguaauccgcuccagguuctt

SEQ ID NO: 177 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
aaccuggagcggauuaccctt

SEQ ID NO: 178 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
ggguaauccgcuccagguutt

SEQ ID NO: 179 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cccuccacgguaccgggcgtt

SEQ ID NO: 180 - DNA, 21 bp, Artificial sequence
  siRNAs to PCSK9
  5'-terminal nucleic acid is a nucleoside, i.e. base + sugar but lacking 5'-phosphate
  modified_base 1..19: /mod_base = "2'-hydroxy corresponding base"
cgcccgguaccguggagggtt

SEQ ID NO: 181 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
cacgguaccgggcggaugatt

SEQ ID NO: 182 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
ucauccgcccgguaccgugtt

SEQ ID NO: 183 - DNA, 21 bp, Artificial sequence
  siRNAs to PCSK9
  5'-terminal nucleic acid is a nucleoside, i.e. base + sugar but lacking 5'-phosphate
  modified_base 1, 3, 6, 8, 9, 13, 17: /mod_base = "2'-O-methyl corresponding base"
  modified_base 21: /mod_base = "5'-thio thymidine"
  modified_base 2, 4, 5, 7, 10, 11, 12, 14, 15, 16, 18, 19: /mod_base = "2'-hydroxy corresponding base"
cacgguaccgggcggaugatt

SEQ ID NO: 184 - DNA, 21 bp, Artificial sequence
  siRNAs to PCSK9
  5'-terminal nucleic acid is a nucleoside, i.e. base + sugar but lacking 5'-phosphate
  modified_base 2, 13: /mod_base = "2'-O-methyl corresponding base"
  modified_base 21: /mod_base = "5'-thio thymidine"
  modified_base 1, 3, 4, 5, 6, 7, 8, 9, 10, 11, 12, 14, 15, 16, 17, 18, 19: /mod_base = "2'-hydroxy corresponding base"
ucauccgcccgguaccgugtt

SEQ ID NO: 185 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
acgguaccgggcggaugaatt

SEQ ID NO: 186 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
uucauccgcccgguaccgutt

SEQ ID NO: 187 - DNA, 21 bp, Artificial sequence
  siRNAs to PCSK9
  5'-terminal nucleic acid is a nucleoside, i.e. base + sugar but lacking 5'-phosphate
  modified_base 2, 5, 7, 8, 12, 16: /mod_base = "2'-O-methyl corresponding base"
  modified_base 21: /mod_base = "5'-thio thymidine"
  modified_base 1, 3, 4, 6, 9, 10, 11, 13, 14, 15, 17, 18, 19: /mod_base = "2'-hydroxy corresponding base"
acgguaccgggcggaugaatt

SEQ ID NO: 188 - DNA, 21 bp, Artificial sequence
  siRNAs to PCSK9
  5'-terminal nucleic acid is a nucleoside, i.e. base + sugar but lacking 5'-phosphate
  modified_base 3, 14: /mod_base = "2'-O-methyl corresponding base"
  modified_base 21: /mod_base = "5'-thio thymidine"
  modified_base 1, 2, 4, 5, 6, 7, 8, 9, 10, 11, 12, 13, 15, 16, 17, 18, 19: /mod_base = "2'-hydroxy corresponding base"
uucauccgcccgguaccgutt

SEQ ID NO: 189 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
cgguaccgggcggaugaautt

SEQ ID NO: 190 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
auucauccgcccgguaccgtt

SEQ ID NO: 191 - DNA, 21 bp, Artificial sequence
  siRNAs to PCSK9
  5'-terminal nucleic acid is a nucleoside, i.e. base + sugar but lacking 5'-phosphate
  modified_base 1, 4, 6, 7, 11, 15, 19: /mod_base = "2'-O-methyl corresponding base"
  modified_base 21: /mod_base = "5'-thio thymidine"
  modified_base 2, 3, 5, 8, 9, 10, 12, 13, 14, 16, 17, 18: /mod_base = "2'-hydroxy corresponding base"
cgguaccgggcggaugaautt

SEQ ID NO: 192 - DNA, 21 bp, Artificial sequence
  siRNAs to PCSK9
  5'-terminal nucleic acid is a nucleoside, i.e. base + sugar but lacking 5'-phosphate
  modified_base 4, 15: /mod_base = "2'-O-methyl corresponding base"
  modified_base 21: /mod_base = "5'-thio thymidine"
  modified_base 1, 2, 3, 5, 6, 7, 8, 9, 10, 11, 12, 13, 14, 16, 17, 18, 19: /mod_base = "2'-hydroxy corresponding base"
auucauccgcccgguaccgtt

SEQ ID NO: 193 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gguaccgggcggaugaauatt

SEQ ID NO: 194 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
uauucauccgcccgguacctt

SEQ ID NO: 195 - DNA, 21 bp, Artificial sequence
  siRNAs to PCSK9
  5'-terminal nucleic acid is a nucleoside, i.e. base + sugar but lacking 5'-phosphate
  modified_base 3, 5, 6, 10, 14, 18: /mod_base = "2'-O-methyl corresponding base"
  modified_base 21: /mod_base = "5'-thio thymidine"
  modified_base 1, 2, 4, 7, 8, 9, 11, 12, 13, 15, 16, 17, 19: /mod_base = "2'-hydroxy corresponding base"
gguaccgggcggaugaauatt

SEQ ID NO: 196 - DNA, 21 bp, Artificial sequence
  siRNAs to PCSK9
  5'-terminal nucleic acid is a nucleoside, i.e. base + sugar but lacking 5'-phosphate
  modified_base 1, 5, 16: /mod_base = "2'-O-methyl corresponding base"
  modified_base 21: /mod_base = "5'-thio thymidine"
  modified_base 2, 3, 4, 6, 7, 8, 9, 10, 11, 12, 13, 14, 15, 17, 18, 19: /mod_base = "2'-hydroxy corresponding base"
uauucauccgcccgguacctt

SEQ ID NO: 197 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
guaccgggcggaugaauactt

SEQ ID NO: 198 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
guauucauccgcccgguactt

SEQ ID NO: 199 - DNA, 21 bp, Artificial sequence
  siRNAs to PCSK9
  5'-terminal nucleic acid is a nucleoside, i.e. base + sugar but lacking 5'-phosphate
  modified_base 2, 4, 5, 9, 13, 17, 19: /mod_base = "2'-O-methyl corresponding base"
  modified_base 21: /mod_base = "5'-thio thymidine"
  modified_base 1, 3, 6, 7, 8, 10, 11, 12, 14, 15, 16, 18: /mod_base = "2'-hydroxy corresponding base"
guaccgggcggaugaauactt

SEQ ID NO: 200 - DNA, 21 bp, Artificial sequence
  siRNAs to PCSK9
  5'-terminal nucleic acid is a nucleoside, i.e. base + sugar but lacking 5'-phosphate
  modified_base 2, 6, 17: /mod_base = "2'-O-methyl corresponding base"
  modified_base 21: /mod_base = "5'-thio thymidine"
  modified_base 1, 3, 4, 5, 7, 8, 9, 10, 11, 12, 13, 14, 15, 16, 18, 19: /mod_base = "2'-hydroxy corresponding base"
guauucauccgcccgguactt

SEQ ID NO: 201 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
accgggcggaugaauaccatt

SEQ ID NO: 202 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
ugguauucauccgcccggutt

SEQ ID NO: 203 - DNA, 21 bp, Artificial sequence
  siRNAs to PCSK9
  5'-terminal nucleic acid is a nucleoside, i.e. base + sugar but lacking 5'-phosphate
  modified_base 2, 3, 7, 11, 15, 17, 18: /mod_base = "2'-O-methyl corresponding base"
  modified_base 21: /mod_base = "5'-thio thymidine"
  modified_base 1, 4, 5, 6, 8, 9, 10, 12, 13, 14, 16, 19: /mod_base = "2'-hydroxy corresponding base"
accgggcggaugaauaccatt

SEQ ID NO: 204 - DNA, 21 bp, Artificial sequence
  siRNAs to PCSK9
  5'-terminal nucleic acid is a nucleoside, i.e. base + sugar but lacking 5'-phosphate
  modified_base 4, 8: /mod_base = "2'-O-methyl corresponding base"
  modified_base 21: /mod_base = "5'-thio thymidine"
  modified_base 1, 2, 3, 5, 6, 7, 9, 10, 11, 12, 13, 14, 15, 16, 17, 18, 19: /mod_base = "2'-hydroxy corresponding base"
ugguauucauccgcccggutt

SEQ ID NO: 205 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
ccgggcggaugaauaccagtt

SEQ ID NO: 206 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
cugguauucauccgcccggtt

SEQ ID NO: 207 - DNA, 21 bp, Artificial sequence
  siRNAs to PCSK9
  5'-terminal nucleic acid is a nucleoside, i.e. base + sugar but lacking 5'-phosphate
  modified_base 1, 2, 6, 10, 14, 16, 17: /mod_base = "2'-O-methyl corresponding base"
  modified_base 21: /mod_base = "5'-thio thymidine"
  modified_base 3, 4, 5, 7, 8, 9, 11, 12, 13, 15, 18, 19: /mod_base = "2'-hydroxy corresponding base"
ccgggcggaugaauaccagtt

SEQ ID NO: 208 - DNA, 21 bp, Artificial sequence
  siRNAs to PCSK9
  5'-terminal nucleic acid is a nucleoside, i.e. base + sugar but lacking 5'-phosphate
  modified_base 5, 9: /mod_base = "2'-O-methyl corresponding base"
  modified_base 21: /mod_base = "5'-thio thymidine"
  modified_base 1, 2, 3, 4, 6, 7, 8, 10, 11, 12, 13, 14, 15, 16, 17, 18, 19: /mod_base = "2'-hydroxy corresponding base"
cugguauucauccgcccggtt

SEQ ID NO: 209 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
ccugguggagguguaucuctt

SEQ ID NO: 210 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gagauacaccuccaccaggtt

SEQ ID NO: 211 - DNA, 21 bp, Artificial sequence
  siRNAs to PCSK9
  5'-terminal nucleic acid is a nucleoside, i.e. base + sugar but lacking 5'-phosphate
  modified_base 1, 2, 3, 6, 12, 14, 16, 17, 18, 19: /mod_base = "2'-O-methyl corresponding base"
  modified_base 21: /mod_base = "5'-thio thymidine"
  modified_base 4, 5, 7, 8, 9, 10, 11, 13, 15: /mod_base = "2'-hydroxy corresponding base"
ccugguggagguguaucuctt

SEQ ID NO: 212 - DNA, 21 bp, Artificial sequence
  siRNAs to PCSK9
  5'-terminal nucleic acid is a nucleoside, i.e. base + sugar but lacking 5'-phosphate
  modified_base 5, 7, 13, 16: /mod_base = "2'-O-methyl corresponding base"
  modified_base 21: /mod_base = "5'-thio thymidine"
  modified_base 1, 2, 3, 4, 6, 8, 9, 10, 11, 12, 14, 15, 17, 18, 19: /mod_base = "2'-hydroxy corresponding base"
gagauacaccuccaccaggtt

SEQ ID NO: 213 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
cugguggagguguaucucctt

SEQ ID NO: 214 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
ggagauacaccuccaccagtt

SEQ ID NO: 215 - DNA, 21 bp, Artificial sequence
  siRNAs to PCSK9
  5'-terminal nucleic acid is a nucleoside, i.e. base + sugar but lacking 5'-phosphate
  modified_base 1, 2, 5, 11, 13, 15, 16, 17, 18, 19: /mod_base = "2'-O-methyl corresponding base"
  modified_base 21: /mod_base = "5'-thio thymidine"
  modified_base 3, 4, 6, 7, 8, 9, 10, 12, 14: /mod_base = "2'-hydroxy corresponding base"
cugguggagguguaucucctt

SEQ ID NO: 216 - DNA, 21 bp, Artificial sequence
  siRNAs to PCSK9
  5'-terminal nucleic acid is a nucleoside, i.e. base + sugar but lacking 5'-phosphate
  modified_base 6, 8, 14, 17: /mod_base = "2'-O-methyl corresponding base"
  modified_base 21: /mod_base = "5'-thio thymidine"
  modified_base 1, 2, 3, 4, 5, 7, 9, 10, 11, 12, 13, 15, 16, 18, 19: /mod_base = "2'-hydroxy corresponding base"
ggagauacaccuccaccagtt

SEQ ID NO: 217 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
ugguggagguguaucuccutt

SEQ ID NO: 218 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
aggagauacaccuccaccatt

SEQ ID NO: 219 - DNA, 21 bp, Artificial sequence
  siRNAs to PCSK9
  5'-terminal nucleic acid is a nucleoside, i.e. base + sugar but lacking 5'-phosphate
  modified_base 1, 4, 10, 12, 14, 15, 16, 17, 18, 19: /mod_base = "2'-O-methyl corresponding base"
  modified_base 21: /mod_base = "5'-thio thymidine"
  modified_base 2, 3, 5, 6, 7, 8, 9, 11, 13: /mod_base = "2'-hydroxy corresponding base"
ugguggagguguaucuccutt

SEQ ID NO: 220 - DNA, 21 bp, Artificial sequence
  siRNAs to PCSK9
  5'-terminal nucleic acid is a nucleoside, i.e. base + sugar but lacking 5'-phosphate
  modified_base 7, 9, 15, 18: /mod_base = "2'-O-methyl corresponding base"
  modified_base 21: /mod_base = "5'-thio thymidine"
  modified_base 1, 2, 3, 4, 5, 6, 8, 10, 11, 12, 13, 14, 16, 17, 19: /mod_base = "2'-hydroxy corresponding base"
aggagauacaccuccaccatt

SEQ ID NO: 221 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gguggagguguaucuccuatt

SEQ ID NO: 222 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
uaggagauacaccuccacctt

SEQ ID NO: 223 - DNA, 21 bp, Artificial sequence
  siRNAs to PCSK9
  5'-terminal nucleic acid is a nucleoside, i.e. base + sugar but lacking 5'-phosphate
  modified_base 3, 9, 11, 13, 14, 15, 16, 17, 18: /mod_base = "2'-O-methyl corresponding base"
  modified_base 21: /mod_base = "5'-thio thymidine"
  modified_base 1, 2, 4, 5, 6, 7, 8, 10, 12, 19: /mod_base = "2'-hydroxy corresponding base"
gguggagguguaucuccuatt

SEQ ID NO: 224 - DNA, 21 bp, Artificial sequence
  siRNAs to PCSK9
  5'-terminal nucleic acid is a nucleoside, i.e. base + sugar but lacking 5'-phosphate
  modified_base 1, 8, 10, 16: /mod_base = "2'-O-methyl corresponding base"
  modified_base 21: /mod_base = "5'-thio thymidine"
  modified_base 2, 3, 4, 5, 6, 7, 9, 11, 12, 13, 14, 15, 17, 18, 19: /mod_base = "2'-hydroxy corresponding base"
uaggagauacaccuccacctt

SEQ ID NO: 225 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
ggagguguaucuccuagactt

SEQ ID NO: 226 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gucuaggagauacaccucctt

SEQ ID NO: 227 - DNA, 21 bp, Artificial sequence
  siRNAs to PCSK9
  5'-terminal nucleic acid is a nucleoside, i.e. base + sugar but lacking 5'-phosphate
  modified_base 6, 8, 10, 11, 12, 13, 14, 15, 19: /mod_base = "2'-O-methyl corresponding base"
  modified_base 21: /mod_base = "5'-thio thymidine"
  modified_base 1, 2, 3, 4, 5, 7, 9, 16, 17, 18: /mod_base = "2'-hydroxy corresponding base"
ggagguguaucuccuagactt

SEQ ID NO: 228 - DNA, 21 bp, Artificial sequence
  siRNAs to PCSK9
  5'-terminal nucleic acid is a nucleoside, i.e. base + sugar but lacking 5'-phosphate
  modified_base 4, 11, 13: /mod_base = "2'-O-methyl corresponding base"
  modified_base 21: /mod_base = "5'-thio thymidine"
  modified_base 1, 2, 3, 5, 6, 7, 8, 9, 10, 12, 14, 15, 16, 17, 18, 19: /mod_base = "2'-hydroxy corresponding base"
gucuaggagauacaccucctt

SEQ ID NO: 229 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
agguguaucuccuagacactt

SEQ ID NO: 230 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gugucuaggagauacaccutt

SEQ ID NO: 231 - DNA, 21 bp, Artificial sequence
  siRNAs to PCSK9
  5'-terminal nucleic acid is a nucleoside, i.e. base + sugar but lacking 5'-phosphate
  modified_base 4, 6, 8, 9, 10, 11, 12, 13, 17, 19: /mod_base = "2'-O-methyl corresponding base"
  modified_base 21: /mod_base = "5'-thio thymidine"
  modified_base 1, 2, 3, 5, 7, 14, 15, 16, 18: /mod_base = "2'-hydroxy corresponding base"
agguguaucuccuagacactt

SEQ ID NO: 232 - DNA, 21 bp, Artificial sequence
  siRNAs to PCSK9
  5'-terminal nucleic acid is a nucleoside, i.e. base + sugar but lacking 5'-phosphate
  modified_base 6, 13, 15: /mod_base = "2'-O-methyl corresponding base"
  modified_base 21: /mod_base = "5'-thio thymidine"
  modified_base 1, 2, 3, 4, 5, 7, 8, 9, 10, 11, 12, 14, 16, 17, 18, 19: /mod_base = "2'-hydroxy corresponding base"
gugucuaggagauacaccutt

SEQ ID NO: 233 - DNA, 21 bp, Artificial sequence
  siRNAs to PCSK9
  5'-terminal nucleic acid is a nucleoside, i.e. base + sugar but lacking 5'-phosphate
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
agguguaucuccuagacactt

SEQ ID NO: 234 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
gugucuaggagauacaccutt

SEQ ID NO: 235 - DNA, 21 bp, Artificial sequence
  siRNAs to PCSK9
  modified_base 4, 6, 8, 9, 10, 11, 12, 13, 17, 19: /mod_base = "2'-deoxy-2'-fluoro corresponding base"
  modified_base 21: /mod_base = "5'-thio thymidine"
  modified_base 1, 2, 3, 5, 7, 14, 15, 16, 18: /mod_base = "2'-hydroxy corresponding base"
agguguaucuccuagacactt

SEQ ID NO: 236 - DNA, 21 bp, Artificial sequence
  siRNAs to PCSK9
  modified_base 2, 4, 5, 6, 13, 15, 17, 18, 19: /mod_base = "2'-deoxy-2'-fluoro corresponding base"
  modified_base 21: /mod_base = "5'-thio thymidine"
  modified_base 1, 3, 7, 8, 9, 10, 11, 12, 14, 16: /mod_base = "2'-hydroxy corresponding base"
gugucuaggagauacaccutt

SEQ ID NO: 237 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
agguguaucuccuagacactt

SEQ ID NO: 238 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
gugucuaggagauacaccutt

SEQ ID NO: 239 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
agguguaucuccuagacactt

SEQ ID NO: 240 - DNA, 21 bp, Artificial sequence
  siRNAs to PCSK9
  modified_base 2, 4, 5, 6, 13, 15, 17, 18, 19: /mod_base = "2'-deoxy-2'-fluoro corresponding base"
  modified_base 21: /mod_base = "5'-thio thymidine"
  modified_base 1, 3, 7, 8, 9, 10, 11, 12, 14, 16: /mod_base = "2'-hydroxy corresponding base"
gugucuaggagauacaccutt

SEQ ID NO: 241 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
agguguaucuccuagacactt

SEQ ID NO: 242 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
gugucuaggagauacaccutt

SEQ ID NO: 243 - DNA, 21 bp, Artificial sequence
  siRNAs to PCSK9
  modified_base 4, 6, 8, 9, 10, 11, 12, 13, 17, 19: /mod_base = "2'-deoxy-2'-fluoro corresponding base"
  modified_base 21: /mod_base = "5'-thio thymidine"
  modified_base 1, 2, 3, 5, 7, 14, 15, 16, 18: /mod_base = "2'-hydroxy corresponding base"
agguguaucuccuagacactt

SEQ ID NO: 244 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
gugucuaggagauacaccutt

SEQ ID NO: 245 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
agguguaucuccuagacactt

SEQ ID NO: 246 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
gugucuaggagauacaccutt

SEQ ID NO: 247 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
gcacccucauaggccuggatt

SEQ ID NO: 248 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
uccaggccuaugagggugctt

SEQ ID NO: 249 - DNA, 21 bp, Artificial sequence
  siRNAs to PCSK9
  modified_base 2, 4, 5, 6, 7, 8, 10, 14, 15, 16: /mod_base = "2'-deoxy-2'-fluoro corresponding base"
  modified_base 21: /mod_base = "5'-thio thymidine"
  modified_base 1, 3, 9, 11, 12, 13, 17, 18, 19: /mod_base = "2'-hydroxy corresponding base"
gcacccucauaggccuggatt

SEQ ID NO: 250 - DNA, 21 bp, Artificial sequence
  siRNAs to PCSK9
  modified_base 1, 2, 3, 7, 8, 9, 11, 17, 19: /mod_base = "2'-deoxy-2'-fluoro corresponding base"
  modified_base 21: /mod_base = "5'-thio thymidine"
  modified_base 4, 5, 6, 10, 12, 13, 14, 15, 16, 18: /mod_base = "2'-hydroxy corresponding base"
uccaggccuaugagggugctt

SEQ ID NO: 251 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
gcacccucauaggccuggatt

SEQ ID NO: 252 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
uccaggccuaugagggugctt

SEQ ID NO: 253 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
gcacccucauaggccuggatt

SEQ ID NO: 254 - DNA, 21 bp, Artificial sequence
  siRNAs to PCSK9
  modified_base 1, 2, 3, 7, 8, 9, 11, 17, 19: /mod_base = "2'-deoxy-2'-fluoro corresponding base"
  modified_base 21: /mod_base = "5'-thio thymidine"
  modified_base 4, 5, 6, 10, 12, 13, 14, 15, 16, 18: /mod_base = "2'-hydroxy corresponding base"
uccaggccuaugagggugctt

SEQ ID NO: 255 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
gcacccucauaggccuggatt

SEQ ID NO: 256 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
uccaggccuaugagggugctt

SEQ ID NO: 257 - DNA, 21 bp, Artificial sequence
  siRNAs to PCSK9
  modified_base 2, 4, 5, 6, 7, 8, 10, 14, 15, 16: /mod_base = "2'-deoxy-2'-fluoro corresponding base"
  modified_base 21: /mod_base = "5'-thio thymidine"
  modified_base 1, 3, 9, 11, 12, 13, 17, 18, 19: /mod_base = "2'-hydroxy corresponding base"
gcacccucauaggccuggatt

SEQ ID NO: 258 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
uccaggccuaugagggugctt

SEQ ID NO: 259 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
gcacccucauaggccuggatt

SEQ ID NO: 260 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
uccaggccuaugagggugctt

SEQ ID NO: 261 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uguaucuccuagacaccagtt

SEQ ID NO: 262 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cuggugucuaggagauacatt

SEQ ID NO: 263 - DNA, 21 bp, Artificial sequence
  siRNAs to PCSK9
  modified_base 1, 3, 5, 6, 7, 8, 9, 10, 14, 16, 17: /mod_base = "2'-O-methyl corresponding base"
  modified_base 21: /mod_base = "5'-thio thymidine"
  modified_base 2, 4, 11, 12, 13, 15, 18, 19: /mod_base = "2'-hydroxy corresponding base"
uguaucuccuagacaccagtt

SEQ ID NO: 264 - DNA, 21 bp, Artificial sequence
  siRNAs to PCSK9
  modified_base 9, 16, 18: /mod_base = "2'-O-methyl corresponding base"
  modified_base 21: /mod_base = "5'-thio thymidine"
  modified_base 1, 2, 3, 4, 5, 6, 7, 8, 10, 11, 12, 13, 14, 15, 17, 19: /mod_base = "2'-hydroxy corresponding base"
cuggugucuaggagauacatt

SEQ ID NO: 265 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ucuccuagacaccagcauatt

SEQ ID NO: 266 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uaugcuggugucuaggagatt

SEQ ID NO: 267 - DNA, 21 bp, Artificial sequence
  siRNAs to PCSK9
  modified_base 1, 2, 3, 4, 5, 6, 10, 12, 13, 16, 18: /mod_base = "2'-O-methyl corresponding base"
  modified_base 21: /mod_base = "5'-thio thymidine"
  modified_base 7, 8, 9, 11, 14, 15, 17, 19: /mod_base = "2'-hydroxy corresponding base"
ucuccuagacaccagcauatt

SEQ ID NO: 268 - DNA, 21 bp, Artificial sequence
  siRNAs to PCSK9
  modified_base 1, 13: /mod_base = "2'-O-methyl corresponding base"
  modified_base 21: /mod_base = "5'-thio thymidine"
  modified_base 2, 3, 4, 5, 6, 7, 8, 9, 10, 11, 12, 14, 15, 16, 17, 18, 19: /mod_base = "2'-hydroxy corresponding base"
uaugcuggugucuaggagatt

SEQ ID NO: 269 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
ucuccuagacaccagcauatt

SEQ ID NO: 270 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
uaugcuggugucuaggagatt

SEQ ID NO: 271 - DNA, 21 bp, Artificial sequence
  siRNAs to PCSK9
  modified_base 1, 2, 3, 4, 5, 6, 10, 12, 13, 16, 18: /mod_base = "2'-deoxy-2'-fluoro corresponding base"
  modified_base 21: /mod_base = "5'-thio thymidine"
  modified_base 7, 8, 9, 11, 14, 15, 17, 19: /mod_base = "2'-hydroxy corresponding base"
ucuccuagacaccagcauatt

SEQ ID NO: 272 - DNA, 21 bp, Artificial sequence
  siRNAs to PCSK9
  modified_base 1, 3, 5, 6, 9, 11, 12, 13: /mod_base = "2'-deoxy-2'-fluoro corresponding base"
  modified_base 21: /mod_base = "5'-thio thymidine"
  modified_base 2, 4, 7, 8, 10, 14, 15, 16, 17, 18, 19: /mod_base = "2'-hydroxy corresponding base"
uaugcuggugucuaggagatt

SEQ ID NO: 273 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ucuccuagacaccagcauatt

SEQ ID NO: 274 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
uaugcuggugucuaggagatt

SEQ ID NO: 275 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ucuccuagacaccagcauatt

SEQ ID NO: 276 - DNA, 21 bp, Artificial sequence
  siRNAs to PCSK9
  modified_base 1, 3, 5, 6, 9, 11, 12, 13: /mod_base = "2'-deoxy-2'-fluoro corresponding base"
  modified_base 21: /mod_base = "5'-thio thymidine"
  modified_base 2, 4, 7, 8, 10, 14, 15, 16, 17, 18, 19: /mod_base = "2'-hydroxy corresponding base"
uaugcuggugucuaggagatt

SEQ ID NO: 277 - DNA, 21 bp, Artificial sequence
  siRNAs to PCSK9
  modified_base 2, 4, 6, 10, 12, 14, 16, 18: /mod_base = "2'-O-methyl corresponding base"
  modified_base 1, 3, 5, 8, 9, 11, 13, 15, 17, 19: /mod_base = "2'-deoxy-2'-fluoro corresponding base"
  modified_base 21: /mod_base = "5'-thio thymidine"
  modified_base 7: /mod_base = "2'-hydroxy corresponding base"
ucuccuaaacaccagcauatt

SEQ ID NO: 278 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
uaugcuggugucuaggagatt

SEQ ID NO: 279 - DNA, 21 bp, Artificial sequence
  siRNAs to PCSK9
  modified_base 1, 2, 3, 4, 5, 6, 10, 12, 13, 16, 18: /mod_base = "2'-deoxy-2'-fluoro corresponding base"
  modified_base 21: /mod_base = "5'-thio thymidine"
  modified_base 7, 8, 9, 11, 14, 15, 17, 19: /mod_base = "2'-hydroxy corresponding base"
ucuccuagacaccagcauatt

SEQ ID NO: 280 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
uaugcuggugucuaggagatt

SEQ ID NO: 281 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ucuccuagacaccagcauatt

SEQ ID NO: 282 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
uaugcuggugucuaggagatt

SEQ ID NO: 283 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
aggccuggaguuuauucggtt

SEQ ID NO: 284 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
ccgaauaaacuccaggccutt

SEQ ID NO: 285 - DNA, 21 bp, Artificial sequence
  siRNAs to PCSK9
  modified_base 4, 5, 6, 11, 12, 13, 15, 16, 17: /mod_base = "2'-deoxy-2'-fluoro corresponding base"
  modified_base 21: /mod_base = "5'-thio thymidine"
  modified_base 1, 2, 3, 7, 8, 9, 10, 14, 18, 19: /mod_base = "2'-hydroxy corresponding base"
aggccuggaguuuauucggtt

SEQ ID NO: 286 - DNA, 21 bp, Artificial sequence
  siRNAs to PCSK9
  modified_base 1, 2, 6, 10, 11, 12, 13, 17, 18, 19: /mod_base = "2'-deoxy-2'-fluoro corresponding base"
  modified_base 21: /mod_base = "5'-thio thymidine"
  modified_base 3, 4, 5, 7, 8, 9, 14, 15, 16: /mod_base = "2'-hydroxy corresponding base"
ccgaauaaacuccaggccutt

SEQ ID NO: 287 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
aggccuggaguuuauucggtt

SEQ ID NO: 288 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
ccgaauaaacuccaggccutt

SEQ ID NO: 289 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
aggccuggaguuuauucggtt

SEQ ID NO: 290 - DNA, 21 bp, Artificial sequence
  siRNAs to PCSK9
  modified_base 1, 2, 6, 10, 11, 12, 13, 17, 18, 19: /mod_base = "2'-deoxy-2'-fluoro corresponding base"
  modified_base 21: /mod_base = "5'-thio thymidine"
  modified_base 3, 4, 5, 7, 8, 9, 14, 15, 16: /mod_base = "2'-hydroxy corresponding base"
ccgaauaaacuccaggccutt

SEQ ID NO: 291 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
aggccuggaguuuauucggtt

SEQ ID NO: 292 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
ccgaauaaacuccaggccutt

SEQ ID NO: 293 - DNA, 21 bp, Artificial sequence
  siRNAs to PCSK9
  modified_base 4, 5, 6, 11, 12, 13, 15, 16, 17: /mod_base = "2'-deoxy-2'-fluoro corresponding base"
  modified_base 21: /mod_base = "5'-thio thymidine"
  modified_base 1, 2, 3, 7, 8, 9, 10, 14, 18, 19: /mod_base = "2'-hydroxy corresponding base"
aggccuggaguuuauucggtt

SEQ ID NO: 294 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
ccgaauaaacuccaggccutt

SEQ ID NO: 295 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
aggccuggaguuuauucggtt

SEQ ID NO: 296 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
ccgaauaaacuccaggccutt

SEQ ID NO: 297 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cuccuagacaccagcauactt

SEQ ID NO: 298 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
guaugcuggugucuaggagtt

SEQ ID NO: 299 - DNA, 21 bp, Artificial sequence
  siRNAs to PCSK9
  modified_base 1, 2, 3, 4, 5, 9, 11, 12, 15, 17, 19: /mod_base = "2'-O-methyl corresponding base"
  modified_base 21: /mod_base = "5'-thio thymidine"
  modified_base 6, 7, 8, 10, 13, 14, 16, 18: /mod_base = "2'-hydroxy corresponding base"
cuccuagacaccagcauactt

SEQ ID NO: 300 - DNA, 21 bp, Artificial sequence
  siRNAs to PCSK9
  modified_base 2, 14: /mod_base = "2'-O-methyl corresponding base"
  modified_base 21: /mod_base = "5'-thio thymidine"
  modified_base 1, 3, 4, 5, 6, 7, 8, 9, 10, 11, 12, 13, 15, 16, 17, 18, 19: /mod_base = "2'-hydroxy corresponding base"
guaugcuggugucuaggagtt

SEQ ID NO: 301 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uccuagacaccagcauacatt

SEQ ID NO: 302 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uguaugcuggugucuaggatt

SEQ ID NO: 303 - DNA, 21 bp, Artificial sequence
  siRNAs to PCSK9
  modified_base 1, 2, 3, 4, 8, 10, 11, 14, 16, 18: /mod_base = "2'-O-methyl corresponding base"
  modified_base 21: /mod_base = "5'-thio thymidine"
  modified_base 5, 6, 7, 9, 12, 13, 15, 17, 19: /mod_base = "2'-hydroxy corresponding base"
uccuagacaccagcauacatt

SEQ ID NO: 304 - DNA, 21 bp, Artificial sequence
  siRNAs to PCSK9
  modified_base 3, 15: /mod_base = "2'-O-methyl corresponding base"
  modified_base 21: /mod_base = "5'-thio thymidine"
  modified_base 1, 2, 4, 5, 6, 7, 8, 9, 10, 11, 12, 13, 14, 16, 17, 18, 19: /mod_base = "2'-hydroxy corresponding base"
uguaugcuggugucuaggatt

SEQ ID NO: 305 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ccuagacaccagcauacagtt

SEQ ID NO: 306 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cuguaugcuggugucuaggtt

SEQ ID NO: 307 - DNA, 21 bp, Artificial sequence
  siRNAs to PCSK9
  modified_base 1, 2, 3, 7, 9, 10, 13, 15, 17: /mod_base = "2'-O-methyl corresponding base"
  modified_base 21: /mod_base = "5'-thio thymidine"
  modified_base 4, 5, 6, 8, 11, 12, 14, 16, 18, 19: /mod_base = "2'-hydroxy corresponding base"
ccuagacaccagcauacagtt

SEQ ID NO: 308 - DNA, 21 bp, Artificial sequence
  siRNAs to PCSK9
  modified_base 4, 16: /mod_base = "2'-O-methyl corresponding base"
  modified_base 21: /mod_base = "5'-thio thymidine"
  modified_base 1, 2, 3, 5, 6, 7, 8, 9, 10, 11, 12, 13, 14, 15, 17, 18, 19: /mod_base = "2'-hydroxy corresponding base"
cuguaugcuggugucuaggtt

SEQ ID NO: 309 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gacaccagcauacagagugtt

SEQ ID NO: 310 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cacucuguaugcugguguctt

SEQ ID NO: 311 - DNA, 21 bp, Artificial sequence
  siRNAs to PCSK9
  modified_base 3, 5, 6, 9, 11, 13, 18: /mod_base = "2'-O-methyl corresponding base"
  modified_base 21: /mod_base = "5'-thio thymidine"
  modified_base 1, 2, 4, 7, 8, 10, 12, 14, 15, 16, 17, 19: /mod_base = "2'-hydroxy corresponding base"
gacaccagcauacagagugtt

SEQ ID NO: 312 - DNA, 21 bp, Artificial sequence
  siRNAs to PCSK9
  modified_base 1, 8: /mod_base = "2'-O-methyl corresponding base"
  modified_base 21: /mod_base = "5'-thio thymidine"
  modified_base 2, 3, 4, 5, 6, 7, 9, 10, 11, 12, 13, 14, 15, 16, 17, 18, 19: /mod_base = "2'-hydroxy corresponding base"
cacucuguaugcugguguctt

SEQ ID NO: 313 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cauacagagugaccaccggtt

SEQ ID NO: 314 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ccgguggucacucuguaugtt

SEQ ID NO: 315 - DNA, 21 bp, Artificial sequence
  siRNAs to PCSK9
  modified_base 1, 3, 5, 10, 13, 14, 16, 17: /mod_base = "2'-O-methyl corresponding base"
  modified_base 21: /mod_base = "5'-thio thymidine"
  modified_base 2, 4, 6, 7, 8, 9, 11, 12, 15, 18, 19: /mod_base = "2'-hydroxy corresponding base"
cauacagagugaccaccggtt

SEQ ID NO: 316 - DNA, 21 bp, Artificial sequence
  siRNAs to PCSK9
  modified_base 9, 16: /mod_base = "2'-O-methyl corresponding base"
  modified_base 21: /mod_base = "5'-thio thymidine"
  modified_base 1, 2, 3, 4, 5, 6, 7, 8, 10, 11, 12, 13, 14, 15, 17, 18, 19: /mod_base = "2'-hydroxy corresponding base"
ccgguggucacucuguaugtt

SEQ ID NO: 317 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
agagugaccaccgggaaautt

SEQ ID NO: 318 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
auuucccgguggucacucutt

SEQ ID NO: 319 - DNA, 21 bp, Artificial sequence
  siRNAs to PCSK9
  modified_base 5, 8, 9, 11, 12, 19: /mod_base = "2'-O-methyl corresponding base"
  modified_base 21: /mod_base = "5'-thio thymidine"
  modified_base 1, 2, 3, 4, 6, 7, 10, 13, 14, 15, 16, 17, 18: /mod_base = "2'-hydroxy corresponding base"
agagugaccaccgggaaautt

SEQ ID NO: 320 - DNA, 21 bp, Artificial sequence
  siRNAs to PCSK9
  modified_base 14: /mod_base = "2'-O-methyl corresponding base"
  modified_base 21: /mod_base = "5'-thio thymidine"
  modified_base 1, 2, 3, 4, 5, 6, 7, 8, 9, 10, 11, 12, 13, 15, 16, 17, 18, 19: /mod_base = "2'-hydroxy corresponding base"
auuucccgguggucacucutt

SEQ ID NO: 321 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gagugaccaccgggaaauctt

SEQ ID NO: 322 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gauuucccgguggucacuctt

SEQ ID NO: 323 - DNA, 21 bp, Artificial sequence
  siRNAs to PCSK9
  modified_base 4, 7, 8, 10, 11, 18, 19: /mod_base = "2'-O-methyl corresponding base"
  modified_base 21: /mod_base = "5'-thio thymidine"
  modified_base 1, 2, 3, 5, 6, 9, 12, 13, 14, 15, 16, 17: /mod_base = "2'-hydroxy corresponding base"
gagugaccaccgggaaauctt

SEQ ID NO: 324 - DNA, 21 bp, Artificial sequence
  siRNAs to PCSK9
  modified_base 15: /mod_base = "2'-O-methyl corresponding base"
  modified_base 21: /mod_base = "5'-thio thymidine"
  modified_base 1, 2, 3, 4, 5, 6, 7, 8, 9, 10, 11, 12, 13, 14, 16, 17, 18, 19: /mod_base = "2'-hydroxy corresponding base"
gauuucccgguggucacuctt

SEQ ID NO: 325 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gugaccaccgggaaaucgatt

SEQ ID NO: 326 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ucgauuucccgguggucactt

SEQ ID NO: 327 - DNA, 21 bp, Artificial sequence
  siRNAs to PCSK9
  modified_base 2, 5, 6, 8, 9, 16, 17: /mod_base = "2'-O-methyl corresponding base"
  modified_base 21: /mod_base = "5'-thio thymidine"
  modified_base 1, 3, 4, 7, 10, 11, 12, 13, 14, 15, 18, 19: /mod_base = "2'-hydroxy corresponding base"
gugaccaccgggaaaucgatt

SEQ ID NO: 328 - DNA, 21 bp, Artificial sequence
  siRNAs to PCSK9
  modified_base 17: /mod_base = "2'-O-methyl corresponding base"
  modified_base 21: /mod_base = "5'-thio thymidine"
  modified_base 1, 2, 3, 4, 5, 6, 7, 8, 9, 10, 11, 12, 13, 14, 15, 16, 18, 19: /mod_base = "2'-hydroxy corresponding base"
ucgauuucccgguggucactt

SEQ ID NO: 329 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gaccaccgggaaaucgaggtt

SEQ ID NO: 330 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ccucgauuucccggugguctt

SEQ ID NO: 331 - DNA, 21 bp, Artificial sequence
  siRNAs to PCSK9
  modified_base 3, 4, 6, 7, 14, 15: /mod_base = "2'-O-methyl corresponding base"
  modified_base 21: /mod_base = "5'-thio thymidine"
  modified_base 1, 2, 5, 8, 9, 10, 11, 12, 13, 16, 17, 18, 19: /mod_base = "2'-hydroxy corresponding base"
gaccaccgggaaaucgaggtt

SEQ ID NO: 332 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ccucgauuucccggugguctt

SEQ ID NO: 333 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
accaccgggaaaucgagggtt

SEQ ID NO: 334 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cccucgauuucccgguggutt

SEQ ID NO: 335 - DNA, 21 bp, Artificial sequence
  siRNAs to PCSK9
  modified_base 2, 3, 5, 6, 13, 14: /mod_base = "2'-O-methyl corresponding base"
  modified_base 21: /mod_base = "5'-thio thymidine"
  modified_base 1, 4, 7, 8, 9, 10, 11, 12, 15, 16, 17, 18, 19: /mod_base = "2'-hydroxy corresponding base"
accaccgggaaaucgagggtt

SEQ ID NO: 336 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cccucgauuucccgguggutt

SEQ ID NO: 337 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ccaccgggaaaucgagggctt

SEQ ID NO: 338 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gcccucgauuucccgguggtt

SEQ ID NO: 339 - DNA, 21 bp, Artificial sequence
  siRNAs to PCSK9
  modified_base 1, 2, 4, 5, 12, 13, 19: /mod_base = "2'-O-methyl corresponding base"
  modified_base 21: /mod_base = "5'-thio thymidine"
  modified_base 3, 6, 7, 8, 9, 10, 11, 14, 15, 16, 17, 18: /mod_base = "2'-hydroxy corresponding base"
ccaccgggaaaucgagggctt

SEQ ID NO: 340 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gcccucgauuucccgguggtt

SEQ ID NO: 341 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
aaaucgagggcagggucautt

SEQ ID NO: 342 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
augacccugcccucgauuutt

SEQ ID NO: 343 - DNA, 21 bp, Artificial sequence
  siRNAs to PCSK9
  modified_base 4, 5, 11, 16, 17, 19: /mod_base = "2'-O-methyl corresponding base"
  modified_base 21: /mod_base = "5'-thio thymidine"
  modified_base 1, 2, 3, 6, 7, 8, 9, 10, 12, 13, 14, 15, 18: /mod_base = "2'-hydroxy corresponding base"
aaaucgagggcagggucautt

SEQ ID NO: 344 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
augacccugcccucgauuutt

SEQ ID NO: 345 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
aaaucgagggcagggucautt

SEQ ID NO: 346 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
augacccugcccucgauuutt

SEQ ID NO: 347 - DNA, 21 bp, Artificial sequence
  siRNAs to PCSK9
  modified_base 4, 5, 11, 16, 17, 19: /mod_base = "2'-deoxy-2'-fluoro corresponding base"
  modified_base 21: /mod_base = "5'-thio thymidine"
  modified_base 1, 2, 3, 6, 7, 8, 9, 10, 12, 13, 14, 15, 18: /mod_base = "2'-hydroxy corresponding base"
aaaucgagggcagggucautt

SEQ ID NO: 348 - DNA, 21 bp, Artificial sequence
  siRNAs to PCSK9
  modified_base 2, 5, 6, 7, 8, 10, 11, 12, 13, 14, 17, 18, 19: /mod_base = "2'-deoxy-2'-fluoro corresponding base"
  modified_base 21: /mod_base = "5'-thio thymidine"
  modified_base 1, 3, 4, 9, 15, 16: /mod_base = "2'-hydroxy corresponding base"
augacccugcccucgauuutt

SEQ ID NO: 349 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
aaaucgagggcagggucautt

SEQ ID NO: 350 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
augacccugcccucgauuutt

SEQ ID NO: 351 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
aaaucgagggcagggucautt

SEQ ID NO: 352 - DNA, 21 bp, Artificial sequence
  siRNAs to PCSK9
  modified_base 2, 5, 6, 7, 8, 10, 11, 12, 13, 14, 17, 18, 19: /mod_base = "2'-deoxy-2'-fluoro corresponding base"
  modified_base 21: /mod_base = "5'-thio thymidine"
  modified_base 1, 3, 4, 9, 15, 16: /mod_base = "2'-hydroxy corresponding base"
augacccugcccucgauuutt

SEQ ID NO: 353 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
aaaucgagggcagggucautt

SEQ ID NO: 354 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
augacccugcccucgauuutt

SEQ ID NO: 355 - DNA, 21 bp, Artificial sequence
  siRNAs to PCSK9
  modified_base 4, 5, 11, 16, 17, 19: /mod_base = "2'-deoxy-2'-fluoro corresponding base"
  modified_base 21: /mod_base = "5'-thio thymidine"
  modified_base 1, 2, 3, 6, 7, 8, 9, 10, 12, 13, 14, 15, 18: /mod_base = "2'-hydroxy corresponding base"
aaaucgagggcagggucautt

SEQ ID NO: 356 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
augacccugcccucgauuutt

SEQ ID NO: 357 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
aaaucgagggcagggucautt

SEQ ID NO: 358 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
augacccugcccucgauuutt

SEQ ID NO: 359 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
cggcacccucauaggccugtt

SEQ ID NO: 360 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
caggccuaugagggugccgtt

SEQ ID NO: 361 - DNA, 21 bp, Artificial sequence
  siRNAs to PCSK9
  modified_base 1, 4, 6, 7, 8, 9, 10, 12, 16, 17, 18: /mod_base = "2'-deoxy-2'-fluoro corresponding base"
  modified_base 21: /mod_base = "5'-thio thymidine"
  modified_base 2, 3, 5, 11, 13, 14, 15, 19: /mod_base = "2'-hydroxy corresponding base"
cggcacccucauaggccugtt

SEQ ID NO: 362 - DNA, 21 bp, Artificial sequence
  siRNAs to PCSK9
  modified_base 1, 5, 6, 7, 9, 15, 17, 18: /mod_base = "2'-deoxy-2'-fluoro corresponding base"
  modified_base 21: /mod_base = "5'-thio thymidine"
  modified_base 2, 3, 4, 8, 10, 11, 12, 13, 14, 16, 19: /mod_base = "2'-hydroxy corresponding base"
caggccuaugagggugccgtt

SEQ ID NO: 363 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
cggcacccucauaggccugtt

SEQ ID NO: 364 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
caggccuaugagggugccgtt

SEQ ID NO: 365 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
cggcacccucauaggccugtt

SEQ ID NO: 366 - DNA, 21 bp, Artificial sequence
  siRNAs to PCSK9
  modified_base 1, 5, 6, 7, 9, 15, 17, 18: /mod_base = "2'-deoxy-2'-fluoro corresponding base"
  modified_base 21: /mod_base = "5'-thio thymidine"
  modified_base 2, 3, 4, 8, 10, 11, 12, 13, 14, 16, 19: /mod_base = "2'-hydroxy corresponding base"
caggccuaugagggugccgtt

SEQ ID NO: 367 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
cggcacccucauaggccugtt

SEQ ID NO: 368 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
caggccuaugagggugccgtt

SEQ ID NO: 369 - DNA, 21 bp, Artificial sequence
  siRNAs to PCSK9
  modified_base 1, 4, 6, 7, 8, 9, 10, 12, 16, 17, 18: /mod_base = "2'-deoxy-2'-fluoro corresponding base"
  modified_base 21: /mod_base = "5'-thio thymidine"
  modified_base 2, 3, 5, 11, 13, 14, 15, 19: /mod_base = "2'-hydroxy corresponding base"
cggcacccucauaggccugtt

SEQ ID NO: 370 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
caggccuaugagggugccgtt

SEQ ID NO: 371 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
cggcacccucauaggccugtt

SEQ ID NO: 372 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
caggccuaugagggugccgtt

SEQ ID NO: 373 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
aucgagggcagggucauggtt

SEQ ID NO: 374 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ccaugacccugcccucgautt

SEQ ID NO: 375 - DNA, 21 bp, Artificial sequence
  siRNAs to PCSK9
  modified_base 2, 3, 9, 14, 15, 17: /mod_base = "2'-O-methyl corresponding base"
  modified_base 21: /mod_base = "5'-thio thymidine"
  modified_base 1, 4, 5, 6, 7, 8, 10, 11, 12, 13, 16, 18, 19: /mod_base = "2'-hydroxy corresponding base"
aucgagggcagggucauggtt

SEQ ID NO: 376 - DNA, 21 bp, Artificial sequence
  siRNAs to PCSK9
  modified_base 2: /mod_base = "2'-O-methyl corresponding base"
  modified_base 21: /mod_base = "5'-thio thymidine"
  modified_base 1, 3, 4, 5, 6, 7, 8, 9, 10, 11, 12, 13, 14, 15, 16, 17, 18, 19: /mod_base = "2'-hydroxy corresponding base"
ccaugacccugcccucgautt

SEQ ID NO: 377 - DNA, 21 bp, Artificial sequence
  siRNAs to PCSK9
  modified_base 1, 7, 12, 13, 15, 18, 19: /mod_base = "2'-O-methyl corresponding base"
  modified_base 21: /mod_base = "5'-thio thymidine"
  modified_base 2, 3, 4, 5, 6, 8, 9, 10, 11, 14, 16, 17: /mod_base = "2'-hydroxy corresponding base"
cgagggcagggucaugguctt

SEQ ID NO: 378 - DNA, 21 bp, Artificial sequence
  siRNAs to PCSK9
  modified_base 4: /mod_base = "2'-O-methyl corresponding base"
  modified_base 21: /mod_base = "5'-thio thymidine"
  modified_base 1, 2, 3, 5, 6, 7, 8, 9, 10, 11, 12, 13, 14, 15, 16, 17, 18, 19: /mod_base = "2'-hydroxy corresponding base"
gaccaugacccugcccucgtt

SEQ ID NO: 379 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gagggcagggucauggucatt

SEQ ID NO: 380 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ugaccaugacccugcccuctt

SEQ ID NO: 381 - DNA, 21 bp, Artificial sequence
  siRNAs to PCSK9
  modified_base 6, 11, 12, 14, 17, 18: /mod_base = "2'-O-methyl corresponding base"
  modified_base 21: /mod_base = "5'-thio thymidine"
  modified_base 1, 2, 3, 4, 5, 7, 8, 9, 10, 13, 15, 16, 19: /mod_base = "2'-hydroxy corresponding base"
gagggcagggucauggucatt

SEQ ID NO: 382 - DNA, 21 bp, Artificial sequence
  siRNAs to PCSK9
  modified_base 5: /mod_base = "2'-O-methyl corresponding base"
  modified_base 21: /mod_base = "5'-thio thymidine"
  modified_base 1, 2, 3, 4, 6, 7, 8, 9, 10, 11, 12, 13, 14, 15, 16, 17, 18, 19: /mod_base = "2'-hydroxy corresponding base"
ugaccaugacccugcccuctt

SEQ ID NO: 383 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gggcagggucauggucacctt

SEQ ID NO: 384 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ggugaccaugacccugccctt

SEQ ID NO: 385 - DNA, 21 bp, Artificial sequence
  siRNAs to PCSK9
  modified_base 4, 9, 10, 12, 15, 16, 18, 19: /mod_base = "2'-O-methyl corresponding base"
  modified_base 21: /mod_base = "5'-thio thymidine"
  modified_base 1, 2, 3, 5, 6, 7, 8, 11, 13, 14, 17: /mod_base = "2'-hydroxy corresponding base"
gggcagggucauggucacctt

SEQ ID NO: 386 - DNA, 21 bp, Artificial sequence
  siRNAs to PCSK9
  modified_base 7: /mod_base = "2'-O-methyl corresponding base"
  modified_base 21: /mod_base = "5'-thio thymidine"
  modified_base 1, 2, 3, 4, 5, 6, 8, 9, 10, 11, 12, 13, 14, 15, 16, 17, 18, 19: /mod_base = "2'-hydroxy corresponding base"
ggugaccaugacccugccctt

SEQ ID NO: 387 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cagggucauggucaccgactt

SEQ ID NO: 388 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gucggugaccaugacccugtt

SEQ ID NO: 389 - DNA, 21 bp, Artificial sequence
  siRNAs to PCSK9
  modified_base 1, 6, 7, 9, 12, 13, 15, 16, 19: /mod_base = "2'-O-methyl corresponding base"
  modified_base 21: /mod_base = "5'-thio thymidine"
  modified_base 2, 3, 4, 5, 8, 10, 11, 14, 17, 18: /mod_base = "2'-hydroxy corresponding base"
cagggucauggucaccgactt

SEQ ID NO: 390 - DNA, 21 bp, Artificial sequence
  siRNAs to PCSK9
  modified_base 10: /mod_base = "2'-O-methyl corresponding base"
  modified_base 21: /mod_base = "5'-thio thymidine"
  modified_base 1, 2, 3, 4, 5, 6, 7, 8, 9, 11, 12, 13, 14, 15, 16, 17, 18, 19: /mod_base = "2'-hydroxy corresponding base"
gucggugaccaugacccugtt

SEQ ID NO: 391 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
agggucauggucaccgacutt

SEQ ID NO: 392 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
agucggugaccaugacccutt

SEQ ID NO: 393 - DNA, 21 bp, Artificial sequence
  siRNAs to PCSK9
  modified_base 5, 6, 8, 11, 12, 14, 15, 18, 19: /mod_base = "2'-O-methyl corresponding base"
  modified_base 21: /mod_base = "5'-thio thymidine"
  modified_base 1, 2, 3, 4, 7, 9, 10, 13, 16, 17: /mod_base = "2'-hydroxy corresponding base"
agggucauggucaccgacutt

SEQ ID NO: 394 - DNA, 21 bp, Artificial sequence
  siRNAs to PCSK9
  modified_base 11: /mod_base = "2'-O-methyl corresponding base"
  modified_base 21: /mod_base = "5'-thio thymidine"
  modified_base 1, 2, 3, 4, 5, 6, 7, 8, 9, 10, 12, 13, 14, 15, 16, 17, 18, 19: /mod_base = "2'-hydroxy corresponding base"
agucggugaccaugacccutt

SEQ ID NO: 395 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
auggucaccgacuucgagatt

SEQ ID NO: 396 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ucucgaagucggugaccautt

SEQ ID NO: 397 - DNA, 21 bp, Artificial sequence
  siRNAs to PCSK9
  modified_base 2, 5, 6, 8, 9, 12, 13, 14, 15: /mod_base = "2'-O-methyl corresponding base"
  modified_base 21: /mod_base = "5'-thio thymidine"
  modified_base 1, 3, 4, 7, 10, 11, 16, 17, 18, 19: /mod_base = "2'-hydroxy corresponding base"
auggucaccgacuucgagatt

SEQ ID NO: 398 - DNA, 21 bp, Artificial sequence
  siRNAs to PCSK9
  modified_base 17: /mod_base = "2'-O-methyl corresponding base"
  modified_base 21: /mod_base = "5'-thio thymidine"
  modified_base 1, 2, 3, 4, 5, 6, 7, 8, 9, 10, 11, 12, 13, 14, 15, 16, 18, 19: /mod_base = "2'-hydroxy corresponding base"
ucucgaagucggugaccautt

SEQ ID NO: 399 - DNA, 21 bp, Artificial sequence
  siRNAs to PCSK9
  modified_base 1..19: /mod_base = "2'-hydroxy corresponding base"
ccgacuucgagaaugugcctt

SEQ ID NO: 400 - DNA, 21 bp, Artificial sequence
  siRNAs to PCSK9
  modified_base 1..19: /mod_base = "2'-hydroxy corresponding base"
ggcacauucucgaagucggtt

SEQ ID NO: 401 - DNA, 21 bp, Artificial sequence
  siRNAs to PCSK9
  modified_base 1..19: /mod_base = "2'-hydroxy corresponding base"
ggaggacgggacccgcuuctt

SEQ ID NO: 402 - DNA, 21 bp, Artificial sequence
  siRNAs to PCSK9
  modified_base 1..19: /mod_base = "2'-hydroxy corresponding base"
gaagcgggucccguccucctt

SEQ ID NO: 403 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cagcggccgggaugccggctt

SEQ ID NO: 404 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gccggcaucccggccgcugtt

SEQ ID NO: 405 - DNA, 21 bp, Artificial sequence
  siRNAs to PCSK9
  modified_base 1, 4, 7, 8, 13, 15, 16, 19: /mod_base = "2'-O-methyl corresponding base"
  modified_base 21: /mod_base = "5'-thio thymidine"
  modified_base 2, 3, 5, 6, 9, 10, 11, 12, 14, 17, 18: /mod_base = "2'-hydroxy corresponding base"
cagcggccgggaugccggctt

SEQ ID NO: 406 - DNA, 21 bp, Artificial sequence
  siRNAs to PCSK9
  modified_base 6: /mod_base = "2'-O-methyl corresponding base"
  modified_base 21: /mod_base = "5'-thio thymidine"
  modified_base 1, 2, 3, 4, 5, 7, 8, 9, 10, 11, 12, 13, 14, 15, 16, 17, 18, 19: /mod_base = "2'-hydroxy corresponding base"
gccggcaucccggccgcugtt

SEQ ID NO: 407 - DNA, 21 bp, Artificial sequence
  siRNAs to PCSK9
  modified_base 1..19: /mod_base = "2'-hydroxy corresponding base"
gggugccagcaugcgcagctt

SEQ ID NO: 408 - DNA, 21 bp, Artificial sequence
  siRNAs to PCSK9
  modified_base 1..19: /mod_base = "2'-hydroxy corresponding base"
gcugcgcaugcuggcaccctt

SEQ ID NO: 409 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ccugcgcgugcucaacugctt

SEQ ID NO: 410 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gcaguugagcacgcgcaggtt

SEQ ID NO: 411 - DNA, 21 bp, Artificial sequence
  siRNAs to PCSK9
  modified_base 1, 2, 3, 5, 7, 9, 11, 12, 13, 16, 17, 19: /mod_base = "2'-O-methyl corresponding base"
  modified_base 21: /mod_base = "5'-thio thymidine"
  modified_base 4, 6, 8, 10, 14, 15, 18: /mod_base = "2'-hydroxy corresponding base"
ccugcgcgugcucaacugctt

SEQ ID NO: 412 - DNA, 21 bp, Artificial sequence
  siRNAs to PCSK9
  modified_base 2, 10, 16: /mod_base = "2'-O-methyl corresponding base"
  modified_base 21: /mod_base = "5'-thio thymidine"
  modified_base 1, 3, 4, 5, 6, 7, 8, 9, 11, 12, 13, 14, 15, 17, 18, 19: /mod_base = "2'-hydroxy corresponding base"
gcaguugagcacgcgcaggtt

SEQ ID NO: 413 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ugcgcgugcucaacugccatt

SEQ ID NO: 414 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uggcaguugagcacgcgcatt

SEQ ID NO: 415 - DNA, 21 bp, Artificial sequence
  siRNAs to PCSK9
  modified_base 1, 3, 5, 7, 9, 10, 11, 14, 15, 17, 18: /mod_base = "2'-O-methyl corresponding base"
  modified_base 21: /mod_base = "5'-thio thymidine"
  modified_base 2, 4, 6, 8, 12, 13, 16, 19: /mod_base = "2'-hydroxy corresponding base"
ugcgcgugcucaacugccatt

SEQ ID NO: 416 - DNA, 21 bp, Artificial sequence
  siRNAs to PCSK9
  modified_base 4, 12, 18: /mod_base = "2'-O-methyl corresponding base"
  modified_base 21: /mod_base = "5'-thio thymidine"
  modified_base 1, 2, 3, 5, 6, 7, 8, 9, 10, 11, 13, 14, 15, 16, 17, 19: /mod_base = "2'-hydroxy corresponding base"
uggcaguugagcacgcgcatt

SEQ ID NO: 417 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cgcgugcucaacugccaagtt

SEQ ID NO: 418 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cuuggcaguugagcacgcgtt

SEQ ID NO: 419 - DNA, 21 bp, Artificial sequence
  siRNAs to PCSK9
  modified_base 1, 3, 5, 7, 8, 9, 12, 13, 15, 16: /mod_base = "2'-O-methyl corresponding base"
  modified_base 21: /mod_base = "5'-thio thymidine"
  modified_base 2, 4, 6, 10, 11, 14, 17, 18, 19: /mod_base = "2'-hydroxy corresponding base"
cgcgugcucaacugccaagtt

SEQ ID NO: 420 - DNA, 21 bp, Artificial sequence
  siRNAs to PCSK9
  modified_base 6, 14: /mod_base = "2'-O-methyl corresponding base"
  modified_base 21: /mod_base = "5'-thio thymidine"
  modified_base 1, 2, 3, 4, 5, 7, 8, 9, 10, 11, 12, 13, 15, 16, 17, 18, 19: /mod_base = "2'-hydroxy corresponding base"
cuuggcaguugagcacgcgtt

SEQ ID NO: 421 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cugccaagggaagggcacgtt

SEQ ID NO: 422 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cgugcccuucccuuggcagtt

SEQ ID NO: 423 - DNA, 21 bp, Artificial sequence
  siRNAs to PCSK9
  modified_base 1, 2, 4, 5, 16, 18: /mod_base = "2'-O-methyl corresponding base"
  modified_base 21: /mod_base = "5'-thio thymidine"
  modified_base 3, 6, 7, 8, 9, 10, 11, 12, 13, 14, 15, 17, 19: /mod_base = "2'-hydroxy corresponding base"
cugccaagggaagggcacgtt

SEQ ID NO: 424 - DNA, 21 bp, Artificial sequence
  siRNAs to PCSK9
  modified_base 17: /mod_base = "2'-O-methyl corresponding base"
  modified_base 21: /mod_base = "5'-thio thymidine"
  modified_base 1, 2, 3, 4, 5, 6, 7, 8, 9, 10, 11, 12, 13, 14, 15, 16, 18, 19: /mod_base = "2'-hydroxy corresponding base"
cgugcccuucccuuggcagtt

SEQ ID NO: 425 - DNA, 21 bp, Artificial sequence
  siRNAs to PCSK9
  modified_base 1..19: /mod_base = "2'-hydroxy corresponding base"
caagggaagggcacgguuatt

SEQ ID NO: 426 - DNA, 21 bp, Artificial sequence
  siRNAs to PCSK9
  modified_base 1..19: /mod_base = "2'-hydroxy corresponding base"
uaaccgugcccuucccuugtt

SEQ ID NO: 427 - DNA, 21 bp, Artificial sequence
  siRNAs to PCSK9
  modified_base 1..19: /mod_base = "2'-hydroxy corresponding base"
aagggaagggcacgguuagtt

SEQ ID NO: 428 - DNA, 21 bp, Artificial sequence
  siRNAs to PCSK9
  modified_base 1..19: /mod_base = "2'-hydroxy corresponding base"
cuaaccgugcccuucccuutt

SEQ ID NO: 429 - DNA, 21 bp, Artificial sequence
  siRNAs to PCSK9
  modified_base 1..19: /mod_base = "2'-hydroxy corresponding base"
agggaagggcacgguuagctt

SEQ ID NO: 430 - DNA, 21 bp, Artificial sequence
  siRNAs to PCSK9
  modified_base 1..19: /mod_base = "2'-hydroxy corresponding base"
gcuaaccgugcccuucccutt

SEQ ID NO: 431 - DNA, 21 bp, Artificial sequence
  siRNAs to PCSK9
  modified_base 1..19: /mod_base = "2'-hydroxy corresponding base"
gggaagggcacgguuagcgtt

SEQ ID NO: 432 - DNA, 21 bp, Artificial sequence
  siRNAs to PCSK9
  modified_base 1..19: /mod_base = "2'-hydroxy corresponding base"
cgcuaaccgugcccuuccctt

SEQ ID NO: 433 - DNA, 21 bp, Artificial sequence
  siRNAs to PCSK9
  modified_base 1..19: /mod_base = "2'-hydroxy corresponding base"
ggaagggcacgguuagcggtt

SEQ ID NO: 434 - DNA, 21 bp, Artificial sequence
  siRNAs to PCSK9
  modified_base 1..19: /mod_base = "2'-hydroxy corresponding base"
ccgcuaaccgugcccuucctt

SEQ ID NO: 435 - DNA, 21 bp, Artificial sequence
  siRNAs to PCSK9
  modified_base 1..19: /mod_base = "2'-hydroxy corresponding base"
gaagggcacgguuagcggctt

SEQ ID NO: 436 - DNA, 21 bp, Artificial sequence
  siRNAs to PCSK9
  modified_base 1..19: /mod_base = "2'-hydroxy corresponding base"
gccgcuaaccgugcccuuctt

SEQ ID NO: 437 - DNA, 21 bp, Artificial sequence
  siRNAs to PCSK9
  modified_base 1..19: /mod_base = "2'-hydroxy corresponding base"
aagggcacgguuagcggcatt

SEQ ID NO: 438 - DNA, 21 bp, Artificial sequence
  siRNAs to PCSK9
  modified_base 1..19: /mod_base = "2'-hydroxy corresponding base"
ugccgcuaaccgugcccuutt

SEQ ID NO: 439 - DNA, 21 bp, Artificial sequence
  siRNAs to PCSK9
  modified_base 1..19: /mod_base = "2'-hydroxy corresponding base"
agggcacgguuagcggcactt

SEQ ID NO: 440 - DNA, 21 bp, Artificial sequence
  siRNAs to PCSK9
  modified_base 1..19: /mod_base = "2'-hydroxy corresponding base"
gugccgcuaaccgugcccutt

SEQ ID NO: 441 - DNA, 21 bp, Artificial sequence
  siRNAs to PCSK9
  modified_base 1..19: /mod_base = "2'-hydroxy corresponding base"
cacgguuagcggcacccuctt

SEQ ID NO: 442 - DNA, 21 bp, Artificial sequence
  siRNAs to PCSK9
  modified_base 1..19: /mod_base = "2'-hydroxy corresponding base"
gagggugccgcuaaccgugtt

SEQ ID NO: 443 - DNA, 21 bp, Artificial sequence
  siRNAs to PCSK9
  modified_base 1..19: /mod_base = "2'-hydroxy corresponding base"
acgguuagcggcacccucatt

SEQ ID NO: 444 - DNA, 21 bp, Artificial sequence
  siRNAs to PCSK9
  modified_base 1..19: /mod_base = "2'-hydroxy corresponding base"
ugagggugccgcuaaccgutt

SEQ ID NO: 445 - DNA, 21 bp, Artificial sequence
  siRNAs to PCSK9
  modified_base 1..19: /mod_base = "2'-hydroxy corresponding base"
guuagcggcacccucauagtt

SEQ ID NO: 446 - DNA, 21 bp, Artificial sequence
  siRNAs to PCSK9
  modified_base 1..19: /mod_base = "2'-hydroxy corresponding base"
cuaugagggugccgcuaactt

SEQ ID NO: 447 - DNA, 21 bp, Artificial sequence
  siRNAs to PCSK9
  modified_base 1..19: /mod_base = "2'-hydroxy corresponding base"
uuagcggcacccucauaggtt

SEQ ID NO: 448 - DNA, 21 bp, Artificial sequence
  siRNAs to PCSK9
  modified_base 1..19: /mod_base = "2'-hydroxy corresponding base"
ccuaugagggugccgcuaatt

SEQ ID NO: 449 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gcggcacccucauaggccutt

SEQ ID NO: 450 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
aggccuaugagggugccgctt

SEQ ID NO: 451 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gcacccucauaggccuggatt

SEQ ID NO: 452 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uccaggccuaugagggugctt

SEQ ID NO: 453 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ucauaggccuggaguuuautt

SEQ ID NO: 454 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
auaaacuccaggccuaugatt

SEQ ID NO: 455 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ggccuggaguuuauucggatt

SEQ ID NO: 456 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uccgaauaaacuccaggcctt

SEQ ID NO: 457 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gccuggaguuuauucggaatt

SEQ ID NO: 458 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uuccgaauaaacuccaggctt

SEQ ID NO: 459 - DNA, 21 bp, Artificial sequence
  siRNAs to PCSK9
  modified_base 2, 3, 4, 9, 10, 11, 13, 14, 15: /mod_base = "2'-O-methyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 460 - DNA, 21 bp, Artificial sequence
  siRNAs to PCSK9
  modified_base 8, 15: /mod_base = "2'-O-methyl corresponding base"
  modified_base 21: /mod_base = "5'-thio thymidine"
  modified_base 1, 2, 3, 4, 5, 6, 7, 9, 10, 11, 12, 13, 14, 16, 17, 18, 19: /mod_base = "2'-hydroxy corresponding base"
uuccgaauaaacuccaggctt

SEQ ID NO: 461 - DNA, 21 bp, Artificial sequence
  siRNAs to PCSK9
  modified_base 2, 3, 4, 9, 10, 11, 13, 14, 15: /mod_base = "2'-O-methyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 462 - DNA, 20 bp, Artificial sequence
  siRNAs to PCSK9
  modified_base 20: /mod_base = "5'-thio thymidine"
  modified_base 1..18: /mod_base = "2'-hydroxy corresponding base"
uuccgaauaacuccaggctt

SEQ ID NO: 463 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cuggaguuuauucggaaaatt

SEQ ID NO: 464 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uuuuccgaauaaacuccagtt

SEQ ID NO: 465 - DNA, 21 bp, Artificial sequence
  siRNAs to PCSK9
  modified_base 1, 2, 7, 8, 9, 11, 12, 13: /mod_base = "2'-O-methyl corresponding base"
  modified_base 21: /mod_base = "5'-thio thymidine"
  modified_base 3, 4, 5, 6, 10, 14, 15, 16, 17, 18, 19: /mod_base = "2'-hydroxy corresponding base"
cuggaguuuauucggaaaatt

SEQ ID NO: 466 - DNA, 21 bp, Artificial sequence
  siRNAs to PCSK9
  modified_base 10, 17: /mod_base = "2'-O-methyl corresponding base"
  modified_base 21: /mod_base = "5'-thio thymidine"
  modified_base 1, 2, 3, 4, 5, 6, 7, 8, 9, 11, 12, 13, 14, 15, 16, 18, 19: /mod_base = "2'-hydroxy corresponding base"
uuuuccgaauaaacuccagtt

SEQ ID NO: 467 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ggaguuuauucggaaaagctt

SEQ ID NO: 468 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gcuuuuccgaauaaacucctt

SEQ ID NO: 469 - DNA, 21 bp, Artificial sequence
  siRNAs to PCSK9
  modified_base 5, 6, 7, 9, 10, 11, 19: /mod_base = "2'-O-methyl corresponding base"
  modified_base 21: /mod_base = "5'-thio thymidine"
  modified_base 1, 2, 3, 4, 8, 12, 13, 14, 15, 16, 17, 18: /mod_base = "2'-hydroxy corresponding base"
ggaguuuauucggaaaagctt

SEQ ID NO: 470 - DNA, 21 bp, Artificial sequence
  siRNAs to PCSK9
  modified_base 12: /mod_base = "2'-O-methyl corresponding base"
  modified_base 21: /mod_base = "5'-thio thymidine"
  modified_base 1, 2, 3, 4, 5, 6, 7, 8, 9, 10, 11, 13, 14, 15, 16, 17, 18, 19: /mod_base = "2'-hydroxy corresponding base"
gcuuuuccgaauaaacucctt

SEQ ID NO: 471 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gaguuuauucggaaaagcctt

SEQ ID NO: 472 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ggcuuuuccgaauaaacuctt

SEQ ID NO: 473 - DNA, 21 bp, Artificial sequence
  siRNAs to PCSK9
  modified_base 4, 5, 6, 8, 9, 10, 18, 19: /mod_base = "2'-O-methyl corresponding base"
  modified_base 21: /mod_base = "5'-thio thymidine"
  modified_base 1, 2, 3, 7, 11, 12, 13, 14, 15, 16, 17: /mod_base = "2'-hydroxy corresponding base"
gaguuuauucggaaaagcctt

SEQ ID NO: 474 - DNA, 21 bp, Artificial sequence
  siRNAs to PCSK9
  modified_base 13: /mod_base = "2'-O-methyl corresponding base"
  modified_base 21: /mod_base = "5'-thio thymidine"
  modified_base 1, 2, 3, 4, 5, 6, 7, 8, 9, 10, 11, 12, 14, 15, 16, 17, 18, 19: /mod_base = "2'-hydroxy corresponding base"
ggcuuuuccgaauaaacuctt

SEQ ID NO: 475 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uuauucggaaaagccagcutt

SEQ ID NO: 476 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
agcuggcuuuuccgaauaatt

SEQ ID NO: 477 - DNA, 21 bp, Artificial sequence
  siRNAs to PCSK9
  modified_base 1, 2, 4, 5, 6, 14, 15, 18, 19: /mod_base = "2'-O-methyl corresponding base"
  modified_base 21: /mod_base = "5'-thio thymidine"
  modified_base 3, 7, 8, 9, 10, 11, 12, 13, 16, 17: /mod_base = "2'-hydroxy corresponding base"
uuauucggaaaagccagcutt

SEQ ID NO: 478 - DNA, 21 bp, Artificial sequence
  siRNAs to PCSK9
  modified_base 17: /mod_base = "2'-O-methyl corresponding base"
  modified_base 21: /mod_base = "5'-thio thymidine"
  modified_base 1, 2, 3, 4, 5, 6, 7, 8, 9, 10, 11, 12, 13, 14, 15, 16, 18, 19: /mod_base = "2'-hydroxy corresponding base"
agcuggcuuuuccgaauaatt

SEQ ID NO: 479 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cccuggcggguggguacagtt

SEQ ID NO: 480 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cuguacccacccgccagggtt

SEQ ID NO: 481 - DNA, 21 bp, Artificial sequence
  siRNAs to PCSK9
  modified_base 1, 2, 3, 4, 7, 11, 15, 17: /mod_base = "2'-O-methyl corresponding base"
  modified_base 21: /mod_base = "5'-thio thymidine"
  modified_base 5, 6, 8, 9, 10, 12, 13, 14, 16, 18, 19: /mod_base = "2'-hydroxy corresponding base"
cccuggcggguggguacagtt

SEQ ID NO: 482 - DNA, 21 bp, Artificial sequence
  siRNAs to PCSK9
  modified_base 4, 8, 15: /mod_base = "2'-O-methyl corresponding base"
  modified_base 21: /mod_base = "5'-thio thymidine"
  modified_base 1, 2, 3, 5, 6, 7, 9, 10, 11, 12, 13, 14, 16, 17, 18, 19: /mod_base = "2'-hydroxy corresponding base"
cuguacccacccgccagggtt

SEQ ID NO: 483 - DNA, 21 bp, Artificial sequence
  siRNAs to PCSK9
  modified_base 1..19: /mod_base = "2'-hydroxy corresponding base"
ccuggcggguggguacagctt

SEQ ID NO: 484 - DNA, 21 bp, Artificial sequence
  siRNAs to PCSK9
  modified_base 1..19: /mod_base = "2'-hydroxy corresponding base"
gcuguacccacccgccaggtt

SEQ ID NO: 485 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uggcggguggguacagccgtt

SEQ ID NO: 486 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cggcuguacccacccgccatt

SEQ ID NO: 487 - DNA, 21 bp, Artificial sequence
  siRNAs to PCSK9
  modified_base 1, 4, 8, 12, 14, 17, 18: /mod_base = "2'-O-methyl corresponding base"
  modified_base 21: /mod_base = "5'-thio thymidine"
  modified_base 2, 3, 5, 6, 7, 9, 10, 11, 13, 15, 16, 19: /mod_base = "2'-hydroxy corresponding base"
uggcggguggguacagccgtt

SEQ ID NO: 488 - DNA, 21 bp, Artificial sequence
  siRNAs to PCSK9
  modified_base 7, 11, 18: /mod_base = "2'-O-methyl corresponding base"
  modified_base 21: /mod_base = "5'-thio thymidine"
  modified_base 1, 2, 3, 4, 5, 6, 8, 9, 10, 12, 13, 14, 15, 16, 17, 19: /mod_base = "2'-hydroxy corresponding base"
cggcuguacccacccgccatt

SEQ ID NO: 489 - DNA, 21 bp, Artificial sequence
  siRNAs to PCSK9
  modified_base 1..19: /mod_base = "2'-hydroxy corresponding base"
ggcggguggguacagccgctt

SEQ ID NO: 490 - DNA, 21 bp, Artificial sequence
  siRNAs to PCSK9
  modified_base 1..19: /mod_base = "2'-hydroxy corresponding base"
gcggcuguacccacccgcctt

SEQ ID NO: 491 - DNA, 21 bp, Artificial sequence
  siRNAs to PCSK9
  modified_base 1..19: /mod_base = "2'-hydroxy corresponding base"
gguggguacagccgcgucctt

SEQ ID NO: 492 - DNA, 21 bp, Artificial sequence
  siRNAs to PCSK9
  modified_base 1..19: /mod_base = "2'-hydroxy corresponding base"
ggacgcggcuguacccacctt

SEQ ID NO: 493 - DNA, 21 bp, Artificial sequence
  siRNAs to PCSK9
  modified_base 1..19: /mod_base = "2'-hydroxy corresponding base"
uggguacagccgcguccuctt

SEQ ID NO: 494 - DNA, 21 bp, Artificial sequence
  siRNAs to PCSK9
  modified_base 1..19: /mod_base = "2'-hydroxy corresponding base"
gaggacgcggcuguacccatt

SEQ ID NO: 495 - DNA, 21 bp, Artificial sequence
  siRNAs to PCSK9
  modified_base 1..19: /mod_base = "2'-hydroxy corresponding base"
gccgcguccucaacgccgctt

SEQ ID NO: 496 - DNA, 21 bp, Artificial sequence
  siRNAs to PCSK9
  modified_base 1..19: /mod_base = "2'-hydroxy corresponding base"
gcggcguugaggacgcggctt

SEQ ID NO: 497 - DNA, 21 bp, Artificial sequence
  siRNAs to PCSK9
  modified_base 1..19: /mod_base = "2'-hydroxy corresponding base"
ccgcguccucaacgccgcctt

SEQ ID NO: 498 - DNA, 21 bp, Artificial sequence
  siRNAs to PCSK9
  modified_base 1..19: /mod_base = "2'-hydroxy corresponding base"
ggcggcguugaggacgcggtt

SEQ ID NO: 499 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gucgugcuggucaccgcugtt

SEQ ID NO: 500 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cagcggugaccagcacgactt

SEQ ID NO: 501 - DNA, 21 bp, Artificial sequence
  siRNAs to PCSK9
  modified_base 2, 3, 5, 7, 8, 11, 12, 14, 15, 17, 18: /mod_base = "2'-O-methyl corresponding base"
  modified_base 21: /mod_base = "5'-thio thymidine"
  modified_base 1, 4, 6, 9, 10, 13, 16, 19: /mod_base = "2'-hydroxy corresponding base"
gucgugcuggucaccgcugtt

SEQ ID NO: 502 - DNA, 21 bp, Artificial sequence
  siRNAs to PCSK9
  modified_base 1, 11, 14: /mod_base = "2'-O-methyl corresponding base"
  modified_base 21: /mod_base = "5'-thio thymidine"
  modified_base 2, 3, 4, 5, 6, 7, 8, 9, 10, 12, 13, 15, 16, 17, 18, 19: /mod_base = "2'-hydroxy corresponding base"
cagcggugaccagcacgactt

SEQ ID NO: 503 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ucgugcuggucaccgcugctt

SEQ ID NO: 504 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gcagcggugaccagcacgatt

SEQ ID NO: 505 - DNA, 21 bp, Artificial sequence
  siRNAs to PCSK9
  modified_base 1, 2, 4, 6, 7, 10, 11, 13, 14, 16, 17, 19: /mod_base = "2'-O-methyl corresponding base"
  modified_base 21: /mod_base = "5'-thio thymidine"
  modified_base 3, 5, 8, 9, 12, 15, 18: /mod_base = "2'-hydroxy corresponding base"
ucgugcuggucaccgcugctt

SEQ ID NO: 506 - DNA, 21 bp, Artificial sequence
  siRNAs to PCSK9
  modified_base 2, 12, 15: /mod_base = "2'-O-methyl corresponding base"
  modified_base 21: /mod_base = "5'-thio thymidine"
  modified_base 1, 3, 4, 5, 6, 7, 8, 9, 10, 11, 13, 14, 16, 17, 18, 19: /mod_base = "2'-hydroxy corresponding base"
gcagcggugaccagcacgatt

SEQ ID NO: 507 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uggucaccgcugccggcaatt

SEQ ID NO: 508 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uugccggcagcggugaccatt

SEQ ID NO: 509 - DNA, 21 bp, Artificial sequence
  siRNAs to PCSK9
  modified_base 1, 4, 5, 7, 8, 10, 11, 13, 14, 17: /mod_base = "2'-O-methyl corresponding base"
  modified_base 21: /mod_base = "5'-thio thymidine"
  modified_base 2, 3, 6, 9, 12, 15, 16, 18, 19: /mod_base = "2'-hydroxy corresponding base"
uggucaccgcugccggcaatt

SEQ ID NO: 510 - DNA, 21 bp, Artificial sequence
  siRNAs to PCSK9
  modified_base 8, 18: /mod_base = "2'-O-methyl corresponding base"
  modified_base 21: /mod_base = "5'-thio thymidine"
  modified_base 1, 2, 3, 4, 5, 6, 7, 9, 10, 11, 12, 13, 14, 15, 16, 17, 19: /mod_base = "2'-hydroxy corresponding base"
uugccggcagcggugaccatt

SEQ ID NO: 511 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ggucaccgcugccggcaactt

SEQ ID NO: 512 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
guugccggcagcggugacctt

SEQ ID NO: 513 - DNA, 21 bp, Artificial sequence
  siRNAs to PCSK9
  modified_base 3, 4, 6, 7, 9, 10, 12, 13, 16, 19: /mod_base = "2'-O-methyl corresponding base"
  modified_base 21: /mod_base = "5'-thio thymidine"
  modified_base 1, 2, 5, 8, 11, 14, 15, 17, 18: /mod_base = "2'-hydroxy corresponding base"
ggucaccgcugccggcaactt

SEQ ID NO: 514 - DNA, 21 bp, Artificial sequence
  siRNAs to PCSK9
  modified_base 9: /mod_base = "2'-O-methyl corresponding base"
  modified_base 21: /mod_base = "5'-thio thymidine"
  modified_base 1, 2, 3, 4, 5, 6, 7, 8, 10, 11, 12, 13, 14, 15, 16, 17, 18, 19: /mod_base = "2'-hydroxy corresponding base"
guugccggcagcggugacctt

SEQ ID NO: 515 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
caccgcugccggcaacuuctt

SEQ ID NO: 516 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gaaguugccggcagcggugtt

SEQ ID NO: 517 - DNA, 21 bp, Artificial sequence
  siRNAs to PCSK9
  modified_base 1, 3, 4, 6, 7, 9, 10, 13, 16, 17, 18, 19: /mod_base = "2'-O-methyl corresponding base"
  modified_base 21: /mod_base = "5'-thio thymidine"
  modified_base 2, 5, 8, 11, 12, 14, 15: /mod_base = "2'-hydroxy corresponding base"
caccgcugccggcaacuuctt

SEQ ID NO: 518 - DNA, 21 bp, Artificial sequence
  siRNAs to PCSK9
  modified_base 12: /mod_base = "2'-O-methyl corresponding base"
  modified_base 21: /mod_base = "5'-thio thymidine"
  modified_base 1, 2, 3, 4, 5, 6, 7, 8, 9, 10, 11, 13, 14, 15, 16, 17, 18, 19: /mod_base = "2'-hydroxy corresponding base"
gaaguugccggcagcggugtt

SEQ ID NO: 519 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ccgcugccggcaacuuccgtt

SEQ ID NO: 520 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cggaaguugccggcagcggtt

SEQ ID NO: 521 - DNA, 21 bp, Artificial sequence
  siRNAs to PCSK9
  modified_base 1, 2, 4, 5, 7, 8, 11, 14, 15, 16, 17, 18: /mod_base = "2'-O-methyl corresponding base"
  modified_base 21: /mod_base = "5'-thio thymidine"
  modified_base 3, 6, 9, 10, 12, 13, 19: /mod_base = "2'-hydroxy corresponding base"
ccgcugccggcaacuuccgtt

SEQ ID NO: 522 - DNA, 21 bp, Artificial sequence
  siRNAs to PCSK9
  modified_base 14: /mod_base = "2'-O-methyl corresponding base"
  modified_base 21: /mod_base = "5'-thio thymidine"
  modified_base 1, 2, 3, 4, 5, 6, 7, 8, 9, 10, 11, 12, 13, 15, 16, 17, 18, 19: /mod_base = "2'-hydroxy corresponding base"
cggaaguugccggcagcggtt

SEQ ID NO: 523 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cgcugccggcaacuuccggtt

SEQ ID NO: 524 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ccggaaguugccggcagcgtt

SEQ ID NO: 525 - DNA, 21 bp, Artificial sequence
  siRNAs to PCSK9
  modified_base 1, 3, 4, 6, 7, 10, 13, 14, 15, 16, 17: /mod_base = "2'-O-methyl corresponding base"
  modified_base 21: /mod_base = "5'-thio thymidine"
  modified_base 2, 5, 8, 9, 11, 12, 18, 19: /mod_base = "2'-hydroxy corresponding base"
cgcugccggcaacuuccggtt

SEQ ID NO: 526 - DNA, 21 bp, Artificial sequence
  siRNAs to PCSK9
  modified_base 15: /mod_base = "2'-O-methyl corresponding base"
  modified_base 21: /mod_base = "5'-thio thymidine"
  modified_base 1, 2, 3, 4, 5, 6, 7, 8, 9, 10, 11, 12, 13, 14, 16, 17, 18, 19: /mod_base = "2'-hydroxy corresponding base"
ccggaaguugccggcagcgtt

SEQ ID NO: 527 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gcugccggcaacuuccgggtt

SEQ ID NO: 528 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cccggaaguugccggcagctt

SEQ ID NO: 529 - DNA, 21 bp, Artificial sequence
  siRNAs to PCSK9
  modified_base 2, 3, 5, 6, 9, 12, 13, 14, 15, 16: /mod_base = "2'-O-methyl corresponding base"
  modified_base 21: /mod_base = "5'-thio thymidine"
  modified_base 1, 4, 7, 8, 10, 11, 17, 18, 19: /mod_base = "2'-hydroxy corresponding base"
gcugccggcaacuuccgggtt

SEQ ID NO: 530 - DNA, 21 bp, Artificial sequence
  siRNAs to PCSK9
  modified_base 16: /mod_base = "2'-O-methyl corresponding base"
  modified_base 21: /mod_base = "5'-thio thymidine"
  modified_base 1, 2, 3, 4, 5, 6, 7, 8, 9, 10, 11, 12, 13, 14, 15, 17, 18, 19: /mod_base = "2'-hydroxy corresponding base"
cccggaaguugccggcagctt

SEQ ID NO: 531 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cggcaacuuccgggacgautt

SEQ ID NO: 532 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
aucgucccggaaguugccgtt

SEQ ID NO: 533 - DNA, 21 bp, Artificial sequence
  siRNAs to PCSK9
  modified_base 1, 4, 7, 8, 9, 10, 11, 16, 19: /mod_base = "2'-O-methyl corresponding base"
  modified_base 21: /mod_base = "5'-thio thymidine"
  modified_base 2, 3, 5, 6, 12, 13, 14, 15, 17, 18: /mod_base = "2'-hydroxy corresponding base"
cggcaacuuccgggacgautt

SEQ ID NO: 534 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
aucgucccggaaguugccgtt

SEQ ID NO: 535 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ggcaacuuccgggacgaugtt

SEQ ID NO: 536 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
caucgucccggaaguugcctt

SEQ ID NO: 537 - DNA, 21 bp, Artificial sequence
  siRNAs to PCSK9
  modified_base 3, 6, 7, 8, 9, 10, 15, 18: /mod_base = "2'-O-methyl corresponding base"
  modified_base 21: /mod_base = "5'-thio thymidine"
  modified_base 1, 2, 4, 5, 11, 12, 13, 14, 16, 17, 19: /mod_base = "2'-hydroxy corresponding base"
ggcaacuuccgggacgaugtt

SEQ ID NO: 538 - DNA, 21 bp, Artificial sequence
  siRNAs to PCSK9
  modified_base 1: /mod_base = "2'-O-methyl corresponding base"
  modified_base 21: /mod_base = "5'-thio thymidine"
  modified_base 2..19: /mod_base = "2'-hydroxy corresponding base"
caucgucccggaaguugcctt

SEQ ID NO: 539 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uuccgggacgaugccugcctt

SEQ ID NO: 540 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ggcaggcaucgucccggaatt

SEQ ID NO: 541 - DNA, 21 bp, Artificial sequence
  siRNAs to PCSK9
  modified_base 1, 2, 3, 4, 9, 12, 14, 15, 16, 18, 19: /mod_base = "2'-O-methyl corresponding base"
  modified_base 21: /mod_base = "5'-thio thymidine"
  modified_base 5, 6, 7, 8, 10, 11, 13, 17: /mod_base = "2'-hydroxy corresponding base"
uuccgggacgaugccugcctt

SEQ ID NO: 542 - DNA, 21 bp, Artificial sequence
  siRNAs to PCSK9
  modified_base 3, 7: /mod_base = "2'-O-methyl corresponding base"
  modified_base 21: /mod_base = "5'-thio thymidine"
  modified_base 1, 2, 4, 5, 6, 8, 9, 10, 11, 12, 13, 14, 15, 16, 17, 18, 19: /mod_base = "2'-hydroxy corresponding base"
ggcaggcaucgucccggaatt

SEQ ID NO: 543 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ggacgaugccugccucuactt

SEQ ID NO: 544 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
guagaggcaggcaucgucctt

SEQ ID NO: 545 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ggacgaugccugccucuactt

SEQ ID NO: 546 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
guagaggcaggcaucgucctt

SEQ ID NO: 547 - DNA, 21 bp, Artificial sequence
  siRNAs to PCSK9
  modified_base 4, 7, 9, 10, 11, 13, 14, 15, 16, 17, 19: /mod_base = "2'-O-methyl corresponding base"
  modified_base 21: /mod_base = "5'-thio thymidine"
  modified_base 1, 2, 3, 5, 6, 8, 12, 18: /mod_base = "2'-hydroxy corresponding base"
ggacgaugccugccucuactt

SEQ ID NO: 548 - DNA, 21 bp, Artificial sequence
  siRNAs to PCSK9
  modified_base 2, 8, 12: /mod_base = "2'-O-methyl corresponding base"
  modified_base 21: /mod_base = "5'-thio thymidine"
  modified_base 1, 3, 4, 5, 6, 7, 9, 10, 11, 13, 14, 15, 16, 17, 18, 19: /mod_base = "2'-hydroxy corresponding base"
guagaggcaggcaucgucctt

SEQ ID NO: 549 - DNA, 21 bp, Artificial sequence
  siRNAs to PCSK9
  modified_base 1..19: /mod_base = "2'-hydroxy corresponding base"
gcucccgaggucaucacagtt

SEQ ID NO: 550 - DNA, 21 bp, Artificial sequence
  siRNAs to PCSK9
  modified_base 1..19: /mod_base = "2'-hydroxy corresponding base"
cugugaugaccucgggagctt

SEQ ID NO: 551 - DNA, 21 bp, Artificial sequence
  siRNAs to PCSK9
  modified_base 1..19: /mod_base = "2'-hydroxy corresponding base"
cucccgaggucaucacagutt

SEQ ID NO: 552 - DNA, 21 bp, Artificial sequence
  siRNAs to PCSK9
  modified_base 1..19: /mod_base = "2'-hydroxy corresponding base"
acugugaugaccucgggagtt

SEQ ID NO: 553 - DNA, 21 bp, Artificial sequence
  siRNAs to PCSK9
  modified_base 1..19: /mod_base = "2'-hydroxy corresponding base"
ucccgaggucaucacaguutt

SEQ ID NO: 554 - DNA, 21 bp, Artificial sequence
  siRNAs to PCSK9
  modified_base 1..19: /mod_base = "2'-hydroxy corresponding base"
aacugugaugaccucgggatt

SEQ ID NO: 555 - DNA, 21 bp, Artificial sequence
  siRNAs to PCSK9
  modified_base 1..19: /mod_base = "2'-hydroxy corresponding base"
ccaagaccagccggugacctt

SEQ ID NO: 556 - DNA, 21 bp, Artificial sequence
  siRNAs to PCSK9
  modified_base 1..19: /mod_base = "2'-hydroxy corresponding base"
ggucaccggcuggucuuggtt

SEQ ID NO: 557 - DNA, 21 bp, Artificial sequence
  siRNAs to PCSK9
  modified_base 1..19: /mod_base = "2'-hydroxy corresponding base"
caagaccagccggugaccctt

SEQ ID NO: 558 - DNA, 21 bp, Artificial sequence
  siRNAs to PCSK9
  modified_base 1..19: /mod_base = "2'-hydroxy corresponding base"
gggucaccggcuggucuugtt

SEQ ID NO: 559 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
accaacuuuggccgcugugtt

SEQ ID NO: 560 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cacagcggccaaaguuggutt

SEQ ID NO: 561 - DNA, 21 bp, Artificial sequence
  siRNAs to PCSK9
  modified_base 2, 3, 6, 7, 8, 9, 12, 13, 15, 16, 18: /mod_base = "2'-O-methyl corresponding base"
  modified_base 21: /mod_base = "5'-thio thymidine"
  modified_base 1, 4, 5, 10, 11, 14, 17, 19: /mod_base = "2'-hydroxy corresponding base"
accaacuuuggccgcugugtt

SEQ ID NO: 562 - DNA, 21 bp, Artificial sequence
  siRNAs to PCSK9
  modified_base 1, 3, 10: /mod_base = "2'-O-methyl corresponding base"
  modified_base 21: /mod_base = "5'-thio thymidine"
  modified_base 2, 4, 5, 6, 7, 8, 9, 11, 12, 13, 14, 15, 16, 17, 18, 19: /mod_base = "2'-hydroxy corresponding base"
cacagcggccaaaguuggutt

SEQ ID NO: 563 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
caacuuuggccgcugugugtt

SEQ ID NO: 564 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cacacagcggccaaaguugtt

SEQ ID NO: 565 - DNA, 21 bp, Artificial sequence
  siRNAs to PCSK9
  modified_base 1, 4, 5, 6, 7, 10, 11, 13, 14, 16, 18: /mod_base = "2'-O-methyl corresponding base"
  modified_base 21: /mod_base = "5'-thio thymidine"
  modified_base 2, 3, 8, 9, 12, 15, 17, 19: /mod_base = "2'-hydroxy corresponding base"
caacuuuggccgcugugugtt

SEQ ID NO: 566 - DNA, 21 bp, Artificial sequence
  siRNAs to PCSK9
  modified_base 1, 3, 5, 12: /mod_base = "2'-O-methyl corresponding base"
  modified_base 21: /mod_base = "5'-thio thymidine"
  modified_base 2, 4, 6, 7, 8, 9, 10, 11, 13, 14, 15, 16, 17, 18, 19: /mod_base = "2'-hydroxy corresponding base"
cacacagcggccaaaguugtt

SEQ ID NO: 567 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cgcuguguggaccucuuugtt

SEQ ID NO: 568 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
caaagagguccacacagcgtt

SEQ ID NO: 569 - DNA, 21 bp, Artificial sequence
  siRNAs to PCSK9
  modified_base 1, 3, 4, 6, 8, 12, 13, 14, 15, 16, 17, 18: /mod_base = "2'-O-methyl corresponding base"
  modified_base 21: /mod_base = "5'-thio thymidine"
  modified_base 2, 5, 7, 9, 10, 11, 19: /mod_base = "2'-hydroxy corresponding base"
cgcuguguggaccucuuugtt

SEQ ID NO: 570 - DNA, 21 bp, Artificial sequence
  siRNAs to PCSK9
  modified_base 1, 11, 13, 15: /mod_base = "2'-O-methyl corresponding base"
  modified_base 21: /mod_base = "5'-thio thymidine"
  modified_base 2, 3, 4, 5, 6, 7, 8, 9, 10, 12, 14, 16, 17, 18, 19: /mod_base = "2'-hydroxy corresponding base"
caaagagguccacacagcgtt

SEQ ID NO: 571 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gacaucauuggugccuccatt

SEQ ID NO: 572 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uggaggcaccaaugauguctt

SEQ ID NO: 573 - DNA, 21 bp, Artificial sequence
  siRNAs to PCSK9
  modified_base 3, 5, 6, 8, 9, 12, 14, 15, 16, 17, 18: /mod_base = "2'-O-methyl corresponding base"
  modified_base 21: /mod_base = "5'-thio thymidine"
  modified_base 1, 2, 4, 7, 10, 11, 13, 19: /mod_base = "2'-hydroxy corresponding base"
gacaucauuggugccuccatt

SEQ ID NO: 574 - DNA, 21 bp, Artificial sequence
  siRNAs to PCSK9
  modified_base 7, 10: /mod_base = "2'-O-methyl corresponding base"
  modified_base 21: /mod_base = "5'-thio thymidine"
  modified_base 1, 2, 3, 4, 5, 6, 8, 9, 11, 12, 13, 14, 15, 16, 17, 18, 19: /mod_base = "2'-hydroxy corresponding base"
uggaggcaccaaugauguctt

SEQ ID NO: 575 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ucauuggugccuccagcgatt

SEQ ID NO: 576 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ucgcuggaggcaccaaugatt

SEQ ID NO: 577 - DNA, 21 bp, Artificial sequence
  siRNAs to PCSK9
  modified_base 1, 2, 4, 5, 8, 10, 11, 12, 13, 14, 17: /mod_base = "2'-O-methyl corresponding base"
  modified_base 21: /mod_base = "5'-thio thymidine"
  modified_base 3, 6, 7, 9, 15, 16, 18, 19: /mod_base = "2'-hydroxy corresponding base"
ucauuggugccuccagcgatt

SEQ ID NO: 578 - DNA, 21 bp, Artificial sequence
  siRNAs to PCSK9
  modified_base 11, 14: /mod_base = "2'-O-methyl corresponding base"
  modified_base 21: /mod_base = "5'-thio thymidine"
  modified_base 1, 2, 3, 4, 5, 6, 7, 8, 9, 10, 12, 13, 15, 16, 17, 18, 19: /mod_base = "2'-hydroxy corresponding base"
ucgcuggaggcaccaaugatt

SEQ ID NO: 579 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
agcaccugcuuugugucactt

SEQ ID NO: 580 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gugacacaaagcaggugcutt

SEQ ID NO: 581 - DNA, 21 bp, Artificial sequence
  siRNAs to PCSK9
  modified_base 3, 5, 6, 7, 9, 10, 11, 12, 14, 16, 17, 19: /mod_base = "2'-O-methyl corresponding base"
  modified_base 21: /mod_base = "5'-thio thymidine"
  modified_base 1, 2, 4, 8, 13, 15, 18: /mod_base = "2'-hydroxy corresponding base"
agcaccugcuuugugucactt

SEQ ID NO: 582 - DNA, 21 bp, Artificial sequence
  siRNAs to PCSK9
  modified_base 5, 7, 12: /mod_base = "2'-O-methyl corresponding base"
  modified_base 21: /mod_base = "5'-thio thymidine"
  modified_base 1, 2, 3, 4, 6, 8, 9, 10, 11, 13, 14, 15, 16, 17, 18, 19: /mod_base = "2'-hydroxy corresponding base"
gugacacaaagcaggugcutt

SEQ ID NO: 583 - DNA, 21 bp, Artificial sequence
  siRNAs to PCSK9
  modified_base 1..19: /mod_base = "2'-hydroxy corresponding base"
cacagagugggacaucacatt

SEQ ID NO: 584 - DNA, 21 bp, Artificial sequence
  siRNAs to PCSK9
  modified_base 1..19: /mod_base = "2'-hydroxy corresponding base"
ugugaugucccacucugugtt

SEQ ID NO: 585 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
augcugucugccgagccggtt

SEQ ID NO: 586 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ccggcucggcagacagcautt

SEQ ID NO: 587 - DNA, 21 bp, Artificial sequence
  siRNAs to PCSK9
  modified_base 2, 4, 5, 7, 8, 9, 11, 12, 16, 17: /mod_base = "2'-O-methyl corresponding base"
  modified_base 21: /mod_base = "5'-thio thymidine"
  modified_base 1, 3, 6, 10, 13, 14, 15, 18, 19: /mod_base = "2'-hydroxy corresponding base"
augcugucugccgagccggtt

SEQ ID NO: 588 - DNA, 21 bp, Artificial sequence
  siRNAs to PCSK9
  modified_base 10, 14, 17: /mod_base = "2'-O-methyl corresponding base"
  modified_base 21: /mod_base = "5'-thio thymidine"
  modified_base 1, 2, 3, 4, 5, 6, 7, 8, 9, 11, 12, 13, 15, 16, 18, 19: /mod_base = "2'-hydroxy corresponding base"
ccggcucggcagacagcautt

SEQ ID NO: 589 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gucugccgagccggagcuctt

SEQ ID NO: 590 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gagcuccggcucggcagactt

SEQ ID NO: 591 - DNA, 21 bp, Artificial sequence
  siRNAs to PCSK9
  modified_base 2, 3, 4, 6, 7, 11, 12, 17, 18, 19: /mod_base = "2'-O-methyl corresponding base"
  modified_base 21: /mod_base = "5'-thio thymidine"
  modified_base 1, 5, 8, 9, 10, 13, 14, 15, 16: /mod_base = "2'-hydroxy corresponding base"
gucugccgagccggagcuctt

SEQ ID NO: 592 - DNA, 21 bp, Artificial sequence
  siRNAs to PCSK9
  modified_base 15: /mod_base = "2'-O-methyl corresponding base"
  modified_base 21: /mod_base = "5'-thio thymidine"
  modified_base 1, 2, 3, 4, 5, 6, 7, 8, 9, 10, 11, 12, 13, 14, 16, 17, 18, 19: /mod_base = "2'-hydroxy corresponding base"
gagcuccggcucggcagactt

SEQ ID NO: 593 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
guugaggcagagacugauctt

SEQ ID NO: 594 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gaucagucucugccucaactt

SEQ ID NO: 595 - DNA, 21 bp, Artificial sequence
  siRNAs to PCSK9
  modified_base 2, 3, 8, 14, 15, 18, 19: /mod_base = "2'-O-methyl corresponding base"
  modified_base 21: /mod_base = "5'-thio thymidine"
  modified_base 1, 4, 5, 6, 7, 9, 10, 11, 12, 13, 16, 17: /mod_base = "2'-hydroxy corresponding base"
guugaggcagagacugauctt

SEQ ID NO: 596 - DNA, 21 bp, Artificial sequence
  siRNAs to PCSK9
  modified_base 4, 16: /mod_base = "2'-O-methyl corresponding base"
  modified_base 21: /mod_base = "5'-thio thymidine"
  modified_base 1, 2, 3, 5, 6, 7, 8, 9, 10, 11, 12, 13, 14, 15, 17, 18, 19: /mod_base = "2'-hydroxy corresponding base"
gaucagucucugccucaactt

SEQ ID NO: 597 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gcagagacugauccacuuctt

SEQ ID NO: 598 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gaaguggaucagucucugctt

SEQ ID NO: 599 - DNA, 21 bp, Artificial sequence
  siRNAs to PCSK9
  modified_base 2, 8, 9, 12, 13, 14, 16, 17, 18, 19: /mod_base = "2'-O-methyl corresponding base"
  modified_base 21: /mod_base = "5'-thio thymidine"
  modified_base 1, 3, 4, 5, 6, 7, 10, 11, 15: /mod_base = "2'-hydroxy corresponding base"
gcagagacugauccacuuctt

SEQ ID NO: 600 - DNA, 21 bp, Artificial sequence
  siRNAs to PCSK9
  modified_base 10: /mod_base = "2'-O-methyl corresponding base"
  modified_base 21: /mod_base = "5'-thio thymidine"
  modified_base 1, 2, 3, 4, 5, 6, 7, 8, 9, 11, 12, 13, 14, 15, 16, 17, 18, 19: /mod_base = "2'-hydroxy corresponding base"
gaaguggaucagucucugctt

SEQ ID NO: 601 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
agagacugauccacuucuctt

SEQ ID NO: 602 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gagaaguggaucagucucutt

SEQ ID NO: 603 - DNA, 21 bp, Artificial sequence
  siRNAs to PCSK9
  modified_base 6, 7, 10, 11, 12, 14, 15, 16, 17, 18, 19: /mod_base = "2'-O-methyl corresponding base"
  modified_base 21: /mod_base = "5'-thio thymidine"
  modified_base 1, 2, 3, 4, 5, 8, 9, 13: /mod_base = "2'-hydroxy corresponding base"
agagacugauccacuucuctt

SEQ ID NO: 604 - DNA, 21 bp, Artificial sequence
  siRNAs to PCSK9
  modified_base 12: /mod_base = "2'-O-methyl corresponding base"
  modified_base 21: /mod_base = "5'-thio thymidine"
  modified_base 1, 2, 3, 4, 5, 6, 7, 8, 9, 10, 11, 13, 14, 15, 16, 17, 18, 19: /mod_base = "2'-hydroxy corresponding base"
gagaaguggaucagucucutt

SEQ ID NO: 605 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uucucugccaaagaugucatt

SEQ ID NO: 606 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ugacaucuuuggcagagaatt

SEQ ID NO: 607 - DNA, 21 bp, Artificial sequence
  siRNAs to PCSK9
  modified_base 1, 2, 3, 4, 5, 6, 8, 9, 15, 17, 18: /mod_base = "2'-O-methyl corresponding base"
  modified_base 21: /mod_base = "5'-thio thymidine"
  modified_base 7, 10, 11, 12, 13, 14, 16, 19: /mod_base = "2'-hydroxy corresponding base"
uucucugccaaagaugucatt

SEQ ID NO: 608 - DNA, 21 bp, Artificial sequence
  siRNAs to PCSK9
  modified_base 4, 13: /mod_base = "2'-O-methyl corresponding base"
  modified_base 21: /mod_base = "5'-thio thymidine"
  modified_base 1, 2, 3, 5, 6, 7, 8, 9, 10, 11, 12, 14, 15, 16, 17, 18, 19: /mod_base = "2'-hydroxy corresponding base"
ugacaucuuuggcagagaatt

SEQ ID NO: 609 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cucugccaaagaugucauctt

SEQ ID NO: 610 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gaugacaucuuuggcagagtt

SEQ ID NO: 611 - DNA, 21 bp, Artificial sequence
  siRNAs to PCSK9
  modified_base 1, 2, 3, 4, 6, 7, 13, 15, 16, 18, 19: /mod_base = "2'-O-methyl corresponding base"
  modified_base 21: /mod_base = "5'-thio thymidine"
  modified_base 5, 8, 9, 10, 11, 12, 14, 17: /mod_base = "2'-hydroxy corresponding base"
cucugccaaagaugucauctt

SEQ ID NO: 612 - DNA, 21 bp, Artificial sequence
  siRNAs to PCSK9
  modified_base 6, 15: /mod_base = "2'-O-methyl corresponding base"
  modified_base 21: /mod_base = "5'-thio thymidine"
  modified_base 1, 2, 3, 4, 5, 7, 8, 9, 10, 11, 12, 13, 14, 16, 17, 18, 19: /mod_base = "2'-hydroxy corresponding base"
gaugacaucuuuggcagagtt

SEQ ID NO: 613 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cugaggaccagcggguacutt

SEQ ID NO: 614 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
aguacccgcugguccucagtt

SEQ ID NO: 615 - DNA, 21 bp, Artificial sequence
  siRNAs to PCSK9
  modified_base 1, 2, 8, 9, 12, 16, 18, 19: /mod_base = "2'-O-methyl corresponding base"
  modified_base 21: /mod_base = "5'-thio thymidine"
  modified_base 3, 4, 5, 6, 7, 10, 11, 13, 14, 15, 17: /mod_base = "2'-hydroxy corresponding base"
cugaggaccagcggguacutt

SEQ ID NO: 616 - DNA, 21 bp, Artificial sequence
  siRNAs to PCSK9
  modified_base 3, 17: /mod_base = "2'-O-methyl corresponding base"
  modified_base 21: /mod_base = "5'-thio thymidine"
  modified_base 1, 2, 4, 5, 6, 7, 8, 9, 10, 11, 12, 13, 14, 15, 16, 18, 19: /mod_base = "2'-hydroxy corresponding base"
aguacccgcugguccucagtt

SEQ ID NO: 617 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ugaggaccagcggguacugtt

SEQ ID NO: 618 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
caguacccgcugguccucatt

SEQ ID NO: 619 - DNA, 21 bp, Artificial sequence
  siRNAs to PCSK9
  modified_base 1, 7, 8, 11, 15, 17, 18: /mod_base = "2'-O-methyl corresponding base"
  modified_base 21: /mod_base = "5'-thio thymidine"
  modified_base 2, 3, 4, 5, 6, 9, 10, 12, 13, 14, 16, 19: /mod_base = "2'-hydroxy corresponding base"
ugaggaccagcggguacugtt

SEQ ID NO: 620 - DNA, 21 bp, Artificial sequence
  siRNAs to PCSK9
  modified_base 1, 4, 18: /mod_base = "2'-O-methyl corresponding base"
  modified_base 21: /mod_base = "5'-thio thymidine"
  modified_base 2, 3, 5, 6, 7, 8, 9, 10, 11, 12, 13, 14, 15, 16, 17, 19: /mod_base = "2'-hydroxy corresponding base"
caguacccgcugguccucatt

SEQ ID NO: 621 - DNA, 21 bp, Artificial sequence
  siRNAs to PCSK9
  modified_base 1..19: /mod_base = "2'-hydroxy corresponding base"
acuguauggucagcacacutt

SEQ ID NO: 622 - DNA, 21 bp, Artificial sequence
  siRNAs to PCSK9
  modified_base 1..19: /mod_base = "2'-hydroxy corresponding base"
agugugcugaccauacagutt

SEQ ID NO: 623 - DNA, 21 bp, Artificial sequence
  siRNAs to PCSK9
  modified_base 1..19: /mod_base = "2'-hydroxy corresponding base"
uguauggucagcacacucgtt

SEQ ID NO: 624 - DNA, 21 bp, Artificial sequence
  siRNAs to PCSK9
  modified_base 1..19: /mod_base = "2'-hydroxy corresponding base"
cgagugugcugaccauacatt

SEQ ID NO: 625 - DNA, 21 bp, Artificial sequence
  siRNAs to PCSK9
  modified_base 1..19: /mod_base = "2'-hydroxy corresponding base"
guauggucagcacacucggtt

SEQ ID NO: 626 - DNA, 21 bp, Artificial sequence
  siRNAs to PCSK9
  modified_base 1..19: /mod_base = "2'-hydroxy corresponding base"
ccgagugugcugaccauactt

SEQ ID NO: 627 - DNA, 21 bp, Artificial sequence
  siRNAs to PCSK9
  modified_base 1..19: /mod_base = "2'-hydroxy corresponding base"
ggauggccacagccgucgctt

SEQ ID NO: 628 - DNA, 21 bp, Artificial sequence
  siRNAs to PCSK9
  modified_base 1..19: /mod_base = "2'-hydroxy corresponding base"
gcgacggcuguggccaucctt

SEQ ID NO: 629 - DNA, 21 bp, Artificial sequence
  siRNAs to PCSK9
  modified_base 1..19: /mod_base = "2'-hydroxy corresponding base"
gauggccacagccgucgcctt

SEQ ID NO: 630 - DNA, 21 bp, Artificial sequence
  siRNAs to PCSK9
  modified_base 1..19: /mod_base = "2'-hydroxy corresponding base"
ggcgacggcuguggccauctt

SEQ ID NO: 631 - DNA, 21 bp, Artificial sequence
  siRNAs to PCSK9
  modified_base 1..19: /mod_base = "2'-hydroxy corresponding base"
caagcuggucugccgggcctt

SEQ ID NO: 632 - DNA, 21 bp, Artificial sequence
  siRNAs to PCSK9
  modified_base 1..19: /mod_base = "2'-hydroxy corresponding base"
ggcccggcagaccagcuugtt

SEQ ID NO: 633 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cugccgggcccacaacgcutt

SEQ ID NO: 634 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
agcguugugggcccggcagtt

SEQ ID NO: 635 - DNA, 21 bp, Artificial sequence
  siRNAs to PCSK9
  modified_base 1, 2, 4, 5, 9, 10, 11, 13, 16, 18, 19: /mod_base = "2'-O-methyl corresponding base"
  modified_base 21: /mod_base = "5'-thio thymidine"
  modified_base 3, 6, 7, 8, 12, 14, 15, 17: /mod_base = "2'-hydroxy corresponding base"
cugccgggcccacaacgcutt

SEQ ID NO: 636 - DNA, 21 bp, Artificial sequence
  siRNAs to PCSK9
  modified_base 17: /mod_base = "2'-O-methyl corresponding base"
  modified_base 21: /mod_base = "5'-thio thymidine"
  modified_base 1, 2, 3, 4, 5, 6, 7, 8, 9, 10, 11, 12, 13, 14, 15, 16, 18, 19: /mod_base = "2'-hydroxy corresponding base"
agcguugugggcccggcagtt

SEQ ID NO: 637 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ugccgggcccacaacgcuutt

SEQ ID NO: 638 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
aagcguugugggcccggcatt

SEQ ID NO: 639 - DNA, 21 bp, Artificial sequence
  siRNAs to PCSK9
  modified_base 1, 3, 4, 8, 9, 10, 12, 15, 17, 18, 19: /mod_base = "2'-O-methyl corresponding base"
  modified_base 21: /mod_base = "5'-thio thymidine"
  modified_base 2, 5, 6, 7, 11, 13, 14, 16: /mod_base = "2'-hydroxy corresponding base"
ugccgggcccacaacgcuutt

SEQ ID NO: 640 - DNA, 21 bp, Artificial sequence
  siRNAs to PCSK9
  modified_base 18: /mod_base = "2'-O-methyl corresponding base"
  modified_base 21: /mod_base = "5'-thio thymidine"
  modified_base 1, 2, 3, 4, 5, 6, 7, 8, 9, 10, 11, 12, 13, 14, 15, 16, 17, 19: /mod_base = "2'-hydroxy corresponding base"
aagcguugugggcccggcatt

SEQ ID NO: 641 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ccgggcccacaacgcuuuutt

SEQ ID NO: 642 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
aaaagcguugugggcccggtt

SEQ ID NO: 643 - DNA, 21 bp, Artificial sequence
  siRNAs to PCSK9
  modified_base 1, 2, 6, 7, 8, 10, 13, 15, 16, 17, 18, 19: /mod_base = "2'-O-methyl corresponding base"
  modified_base 21: /mod_base = "5'-thio thymidine"
  modified_base 3, 4, 5, 9, 11, 12, 14: /mod_base = "2'-hydroxy corresponding base"
ccgggcccacaacgcuuuutt

SEQ ID NO: 644 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
aaaagcguugugggcccggtt

SEQ ID NO: 645 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gggcccacaacgcuuuuggtt

SEQ ID NO: 646 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ccaaaagcguugugggccctt

SEQ ID NO: 647 - DNA, 21 bp, Artificial sequence
  siRNAs to PCSK9
  modified_base 4, 5, 6, 8, 11, 13, 14, 15, 16, 17: /mod_base = "2'-O-methyl corresponding base"
  modified_base 21: /mod_base = "5'-thio thymidine"
  modified_base 1, 2, 3, 7, 9, 10, 12, 18, 19: /mod_base = "2'-hydroxy corresponding base"
gggcccacaacgcuuuuggtt

SEQ ID NO: 648 - DNA, 21 bp, Artificial sequence
  siRNAs to PCSK9
  modified_base 2: /mod_base = "2'-O-methyl corresponding base"
  modified_base 21: /mod_base = "5'-thio thymidine"
  modified_base 1, 3, 4, 5, 6, 7, 8, 9, 10, 11, 12, 13, 14, 15, 16, 17, 18, 19: /mod_base = "2'-hydroxy corresponding base"
ccaaaagcguugugggccctt

SEQ ID NO: 649 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ggugagggugucuacgccatt

SEQ ID NO: 650 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uggcguagacacccucacctt

SEQ ID NO: 651 - DNA, 21 bp, Artificial sequence
  siRNAs to PCSK9
  modified_base 3, 9, 11, 12, 13, 15, 17, 18: /mod_base = "2'-O-methyl corresponding base"
  modified_base 21: /mod_base = "5'-thio thymidine"
  modified_base 1, 2, 4, 5, 6, 7, 8, 10, 14, 16, 19: /mod_base = "2'-hydroxy corresponding base"
ggugagggugucuacgccatt

SEQ ID NO: 652 - DNA, 21 bp, Artificial sequence
  siRNAs to PCSK9
  modified_base 6, 10, 16: /mod_base = "2'-O-methyl corresponding base"
  modified_base 21: /mod_base = "5'-thio thymidine"
  modified_base 1, 2, 3, 4, 5, 7, 8, 9, 11, 12, 13, 14, 15, 17, 18, 19: /mod_base = "2'-hydroxy corresponding base"
uggcguagacacccucacctt

SEQ ID NO: 653 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gagggugucuacgccauugtt

SEQ ID NO: 654 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
caauggcguagacacccuctt

SEQ ID NO: 655 - DNA, 21 bp, Artificial sequence
  siRNAs to PCSK9
  modified_base 6, 8, 9, 10, 12, 14, 15, 17, 18: /mod_base = "2'-O-methyl corresponding base"
  modified_base 21: /mod_base = "5'-thio thymidine"
  modified_base 1, 2, 3, 4, 5, 7, 11, 13, 16, 19: /mod_base = "2'-hydroxy corresponding base"
gagggugucuacgccauugtt

SEQ ID NO: 656 - DNA, 21 bp, Artificial sequence
  siRNAs to PCSK9
  modified_base 1, 9, 13: /mod_base = "2'-O-methyl corresponding base"
  modified_base 21: /mod_base = "5'-thio thymidine"
  modified_base 2, 3, 4, 5, 6, 7, 8, 10, 11, 12, 14, 15, 16, 17, 18, 19: /mod_base = "2'-hydroxy corresponding base"
caauggcguagacacccuctt

SEQ ID NO: 657 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gccaggugcugccugcuactt

SEQ ID NO: 658 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
guagcaggcagcaccuggctt

SEQ ID NO: 659 - DNA, 21 bp, Artificial sequence
  siRNAs to PCSK9
  modified_base 2, 3, 7, 9, 10, 12, 13, 14, 16, 17, 19: /mod_base = "2'-O-methyl corresponding base"
  modified_base 21: /mod_base = "5'-thio thymidine"
  modified_base 1, 4, 5, 6, 8, 11, 15, 18: /mod_base = "2'-hydroxy corresponding base"
gccaggugcugccugcuactt

SEQ ID NO: 660 - DNA, 21 bp, Artificial sequence
  siRNAs to PCSK9
  modified_base 2, 5, 9, 12: /mod_base = "2'-O-methyl corresponding base"
  modified_base 21: /mod_base = "5'-thio thymidine"
  modified_base 1, 3, 4, 6, 7, 8, 10, 11, 13, 14, 15, 16, 17, 18, 19: /mod_base = "2'-hydroxy corresponding base"
guagcaggcagcaccuggctt

SEQ ID NO: 661 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ccaggugcugccugcuacctt

SEQ ID NO: 662 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gguagcaggcagcaccuggtt

SEQ ID NO: 663 - DNA, 21 bp, Artificial sequence
  siRNAs to PCSK9
  modified_base 1, 2, 6, 8, 9, 11, 12, 13, 15, 16, 18, 19: /mod_base = "2'-O-methyl corresponding base"
  modified_base 21: /mod_base = "5'-thio thymidine"
  modified_base 3, 4, 5, 7, 10, 14, 17: /mod_base = "2'-hydroxy corresponding base"
ccaggugcugccugcuacctt

SEQ ID NO: 664 - DNA, 21 bp, Artificial sequence
  siRNAs to PCSK9
  modified_base 3, 6, 10, 13: /mod_base = "2'-O-methyl corresponding base"
  modified_base 21: /mod_base = "5'-thio thymidine"
  modified_base 1, 2, 4, 5, 7, 8, 9, 11, 12, 14, 15, 16, 17, 18, 19: /mod_base = "2'-hydroxy corresponding base"
gguagcaggcagcaccuggtt

SEQ ID NO: 665 - DNA, 21 bp, Artificial sequence
  siRNAs to PCSK9
  modified_base 1..19: /mod_base = "2'-hydroxy corresponding base"
acccacaagccgccugugctt

SEQ ID NO: 666 - DNA, 21 bp, Artificial sequence
  siRNAs to PCSK9
  modified_base 1..19: /mod_base = "2'-hydroxy corresponding base"
gcacaggcggcuugugggutt

SEQ ID NO: 667 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gugcugaggccacgagguctt

SEQ ID NO: 668 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gaccucguggccucagcactt

SEQ ID NO: 669 - DNA, 21 bp, Artificial sequence
  siRNAs to PCSK9
  modified_base 2, 4, 5, 10, 11, 13, 18, 19: /mod_base = "2'-O-methyl corresponding base"
  modified_base 21: /mod_base = "5'-thio thymidine"
  modified_base 1, 3, 6, 7, 8, 9, 12, 14, 15, 16, 17: /mod_base = "2'-hydroxy corresponding base"
gugcugaggccacgagguctt

SEQ ID NO: 670 - DNA, 21 bp, Artificial sequence
  siRNAs to PCSK9
  modified_base 14, 17: /mod_base = "2'-O-methyl corresponding base"
  modified_base 21: /mod_base = "5'-thio thymidine"
  modified_base 1, 2, 3, 4, 5, 6, 7, 8, 9, 10, 11, 12, 13, 15, 16, 18, 19: /mod_base = "2'-hydroxy corresponding base"
gaccucguggccucagcactt

SEQ ID NO: 671 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ugcugaggccacgaggucatt

SEQ ID NO: 672 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ugaccucguggccucagcatt

SEQ ID NO: 673 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ugcugaggccacgaggucatt

SEQ ID NO: 674 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ugaccucguggccucagcatt

SEQ ID NO: 675 - DNA, 21 bp, Artificial sequence
  siRNAs to PCSK9
  modified_base 1, 3, 4, 9, 10, 12, 17, 18: /mod_base = "2'-O-methyl corresponding base"
  modified_base 21: /mod_base = "5'-thio thymidine"
  modified_base 2, 5, 6, 7, 8, 11, 13, 14, 15, 16, 19: /mod_base = "2'-hydroxy corresponding base"
ugcugaggccacgaggucatt

SEQ ID NO: 676 - DNA, 21 bp, Artificial sequence
  siRNAs to PCSK9
  modified_base 15, 18: /mod_base = "2'-O-methyl corresponding base"
  modified_base 21: /mod_base = "5'-thio thymidine"
  modified_base 1, 2, 3, 4, 5, 6, 7, 8, 9, 10, 11, 12, 13, 14, 16, 17, 19: /mod_base = "2'-hydroxy corresponding base"
ugaccucguggccucagcatt

SEQ ID NO: 677 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
ugcugaggccacgaggucatt

SEQ ID NO: 678 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
ugaccucguggccucagcatt

SEQ ID NO: 679 - DNA, 21 bp, Artificial sequence
  siRNAs to PCSK9
  modified_base 1, 3, 4, 9, 10, 12, 17, 18: /mod_base = "2'-deoxy-2'-fluoro corresponding base"
  modified_base 21: /mod_base = "5'-thio thymidine"
  modified_base 2, 5, 6, 7, 8, 11, 13, 14, 15, 16, 19: /mod_base = "2'-hydroxy corresponding base"
ugcugaggccacgaggucatt

SEQ ID NO: 680 - DNA, 21 bp, Artificial sequence
  siRNAs to PCSK9
  modified_base 1, 4, 5, 6, 7, 9, 12, 13, 14, 15, 18: /mod_base = "2'-deoxy-2'-fluoro corresponding base"
  modified_base 21: /mod_base = "5'-thio thymidine"
  modified_base 2, 3, 8, 10, 11, 16, 17, 19: /mod_base = "2'-hydroxy corresponding base"
ugaccucguggccucagcatt

SEQ ID NO: 681 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ugcugaggccacgaggucatt

SEQ ID NO: 682 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
ugaccucguggccucagcatt

SEQ ID NO: 683 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ugcugaggccacgaggucatt

SEQ ID NO: 684 - DNA, 21 bp, Artificial sequence
  siRNAs to PCSK9
  modified_base 1, 4, 5, 6, 7, 9, 12, 13, 14, 15, 18: /mod_base = "2'-deoxy-2'-fluoro corresponding base"
  modified_base 21: /mod_base = "5'-thio thymidine"
  modified_base 2, 3, 8, 10, 11, 16, 17, 19: /mod_base = "2'-hydroxy corresponding base"
ugaccucguggccucagcatt

SEQ ID NO: 685 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
ugcugaggccacgaggucatt

SEQ ID NO: 686 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
ugaccucguggccucagcatt

SEQ ID NO: 687 - DNA, 21 bp, Artificial sequence
  siRNAs to PCSK9
  modified_base 1, 3, 4, 9, 10, 12, 17, 18: /mod_base = "2'-deoxy-2'-fluoro corresponding base"
  modified_base 21: /mod_base = "5'-thio thymidine"
  modified_base 2, 5, 6, 7, 8, 11, 13, 14, 15, 16, 19: /mod_base = "2'-hydroxy corresponding base"
ugcugaggccacgaggucatt

SEQ ID NO: 688 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
ugaccucguggccucagcatt

SEQ ID NO: 689 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ugcugaggccacgaggucatt

SEQ ID NO: 690 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
ugaccucguggccucagcatt

SEQ ID NO: 691 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
guggucagcggccgggaugtt

SEQ ID NO: 692 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
caucccggccgcugaccactt

SEQ ID NO: 693 - DNA, 21 bp, Artificial sequence
  siRNAs to PCSK9
  modified_base 2, 5, 6, 9, 12, 13, 18: /mod_base = "2'-deoxy-2'-fluoro corresponding base"
  modified_base 21: /mod_base = "5'-thio thymidine"
  modified_base 1, 3, 4, 7, 8, 10, 11, 14, 15, 16, 17, 19: /mod_base = "2'-hydroxy corresponding base"
guggucagcggccgggaugtt

SEQ ID NO: 694 - DNA, 21 bp, Artificial sequence
  siRNAs to PCSK9
  modified_base 1, 3, 4, 5, 6, 9, 10, 12, 13, 16, 17, 19: /mod_base = "2'-deoxy-2'-fluoro corresponding base"
  modified_base 21: /mod_base = "5'-thio thymidine"
  modified_base 2, 7, 8, 11, 14, 15, 18: /mod_base = "2'-hydroxy corresponding base"
caucccggccgcugaccactt

SEQ ID NO: 695 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
guggucagcggccgggaugtt

SEQ ID NO: 696 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
caucccggccgcugaccactt

SEQ ID NO: 697 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
guggucagcggccgggaugtt

SEQ ID NO: 698 - DNA, 21 bp, Artificial sequence
  siRNAs to PCSK9
  modified_base 1, 3, 4, 5, 6, 9, 10, 12, 13, 16, 17, 19: /mod_base = "2'-deoxy-2'-fluoro corresponding base"
  modified_base 21: /mod_base = "5'-thio thymidine"
  modified_base 2, 7, 8, 11, 14, 15, 18: /mod_base = "2'-hydroxy corresponding base"
caucccggccgcugaccactt

SEQ ID NO: 699 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
guggucagcggccgggaugtt

SEQ ID NO: 700 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
caucccggccgcugaccactt

SEQ ID NO: 701 - DNA, 21 bp, Artificial sequence
  siRNAs to PCSK9
  modified_base 2, 5, 6, 9, 12, 13, 18: /mod_base = "2'-deoxy-2'-fluoro corresponding base"
  modified_base 21: /mod_base = "5'-thio thymidine"
  modified_base 1, 3, 4, 7, 8, 10, 11, 14, 15, 16, 17, 19: /mod_base = "2'-hydroxy corresponding base"
guggucagcggccgggaugtt

SEQ ID NO: 702 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
caucccggccgcugaccactt

SEQ ID NO: 703 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
guggucagcggccgggaugtt

SEQ ID NO: 704 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
caucccggccgcugaccactt

SEQ ID NO: 705 - DNA, 21 bp, Artificial sequence
  siRNAs to PCSK9
  modified_base 1..19: /mod_base = "2'-hydroxy corresponding base"
ggccacgaggucagcccaatt

SEQ ID NO: 706 - DNA, 21 bp, Artificial sequence
  siRNAs to PCSK9
  modified_base 1..19: /mod_base = "2'-hydroxy corresponding base"
uugggcugaccucguggcctt

SEQ ID NO: 707 - DNA, 21 bp, Artificial sequence
  siRNAs to PCSK9
  modified_base 1..19: /mod_base = "2'-hydroxy corresponding base"
cgaggucagcccaaccagutt

SEQ ID NO: 708 - DNA, 21 bp, Artificial sequence
  siRNAs to PCSK9
  modified_base 1..19: /mod_base = "2'-hydroxy corresponding base"
acugguugggcugaccucgtt

SEQ ID NO: 709 - DNA, 21 bp, Artificial sequence
  siRNAs to PCSK9
  modified_base 1..19: /mod_base = "2'-hydroxy corresponding base"
gucagcccaaccagugcgutt

SEQ ID NO: 710 - DNA, 21 bp, Artificial sequence
  siRNAs to PCSK9
  modified_base 1..19: /mod_base = "2'-hydroxy corresponding base"
acgcacugguugggcugactt

SEQ ID NO: 711 - DNA, 21 bp, Artificial sequence
  siRNAs to PCSK9
  modified_base 1..19: /mod_base = "2'-hydroxy corresponding base"
cagcccaaccagugcguggtt

SEQ ID NO: 712 - DNA, 21 bp, Artificial sequence
  siRNAs to PCSK9
  modified_base 1..19: /mod_base = "2'-hydroxy corresponding base"
ccacgcacugguugggcugtt

SEQ ID NO: 713 - DNA, 21 bp, Artificial sequence
  siRNAs to PCSK9
  modified_base 1..19: /mod_base = "2'-hydroxy corresponding base"
cacagggaggccagcaucctt

SEQ ID NO: 714 - DNA, 21 bp, Artificial sequence
  siRNAs to PCSK9
  modified_base 1..19: /mod_base = "2'-hydroxy corresponding base"
ggaugcuggccucccugugtt

SEQ ID NO: 715 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ccagcauccacgcuuccugtt

SEQ ID NO: 716 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
caggaagcguggaugcuggtt

SEQ ID NO: 717 - DNA, 21 bp, Artificial sequence
  siRNAs to PCSK9
  modified_base 1, 2, 5, 7, 8, 9, 11, 13, 14, 15, 16, 17, 18: /mod_base = "2'-O-methyl corresponding base"
  modified_base 21: /mod_base = "5'-thio thymidine"
  modified_base 3, 4, 6, 10, 12, 19: /mod_base = "2'-hydroxy corresponding base"
ccagcauccacgcuuccugtt

SEQ ID NO: 718 - DNA, 21 bp, Artificial sequence
  siRNAs to PCSK9
  modified_base 1: /mod_base = "2'-O-methyl corresponding base"
  modified_base 21: /mod_base = "5'-thio thymidine"
  modified_base 2..19: /mod_base = "2'-hydroxy corresponding base"
caggaagcguggaugcuggtt

SEQ ID NO: 719 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
agucaaggagcauggaauctt

SEQ ID NO: 720 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gauuccaugcuccuugacutt

SEQ ID NO: 721 - DNA, 21 bp, Artificial sequence
  siRNAs to PCSK9
  modified_base 3, 4, 11, 13, 18, 19: /mod_base = "2'-O-methyl corresponding base"
  modified_base 21: /mod_base = "5'-thio thymidine"
  modified_base 1, 2, 5, 6, 7, 8, 9, 10, 12, 14, 15, 16, 17: /mod_base = "2'-hydroxy corresponding base"
agucaaggagcauggaauctt

SEQ ID NO: 722 - DNA, 21 bp, Artificial sequence
  siRNAs to PCSK9
  modified_base 6: /mod_base = "2'-O-methyl corresponding base"
  modified_base 21: /mod_base = "5'-thio thymidine"
  modified_base 1, 2, 3, 4, 5, 7, 8, 9, 10, 11, 12, 13, 14, 15, 16, 17, 18, 19: /mod_base = "2'-hydroxy corresponding base"
gauuccaugcuccuugacutt

SEQ ID NO: 723 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
agucaaggagcauggaauctt

SEQ ID NO: 724 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
gauuccaugcuccuugacutt

SEQ ID NO: 725 - DNA, 21 bp, Artificial sequence
  siRNAs to PCSK9
  modified_base 3, 4, 11, 13, 18, 19: /mod_base = "2'-deoxy-2'-fluoro corresponding base"
  modified_base 21: /mod_base = "5'-thio thymidine"
  modified_base 1, 2, 5, 6, 7, 8, 9, 10, 12, 14, 15, 16, 17: /mod_base = "2'-hydroxy corresponding base"
agucaaggagcauggaauctt

SEQ ID NO: 726 - DNA, 21 bp, Artificial sequence
  siRNAs to PCSK9
  modified_base 3, 4, 5, 6, 8, 10, 11, 12, 13, 14, 15, 18, 19: /mod_base = "2'-deoxy-2'-fluoro corresponding base"
  modified_base 21: /mod_base = "5'-thio thymidine"
  modified_base 1, 2, 7, 9, 16, 17: /mod_base = "2'-hydroxy corresponding base"
gauuccaugcuccuugacutt

SEQ ID NO: 727 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
agucaaggagcauggaauctt

SEQ ID NO: 728 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
gauuccaugcuccuugacutt

SEQ ID NO: 729 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
agucaaggagcauggaauctt

SEQ ID NO: 730 - DNA, 21 bp, Artificial sequence
  siRNAs to PCSK9
  modified_base 3, 4, 5, 6, 8, 10, 11, 12, 13, 14, 15, 18, 19: /mod_base = "2'-deoxy-2'-fluoro corresponding base"
  modified_base 21: /mod_base = "5'-thio thymidine"
  modified_base 1, 2, 7, 9, 16, 17: /mod_base = "2'-hydroxy corresponding base"
gauuccaugcuccuugacutt

SEQ ID NO: 731 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
agucaaggagcauggaauctt

SEQ ID NO: 732 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
gauuccaugcuccuugacutt

SEQ ID NO: 733 - DNA, 21 bp, Artificial sequence
  siRNAs to PCSK9
  modified_base 3, 4, 11, 13, 18, 19: /mod_base = "2'-deoxy-2'-fluoro corresponding base"
  modified_base 21: /mod_base = "5'-thio thymidine"
  modified_base 1, 2, 5, 6, 7, 8, 9, 10, 12, 14, 15, 16, 17: /mod_base = "2'-hydroxy corresponding base"
agucaaggagcauggaauctt

SEQ ID NO: 734 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
gauuccaugcuccuugacutt

SEQ ID NO: 735 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
agucaaggagcauggaauctt

SEQ ID NO: 736 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
gauuccaugcuccuugacutt

SEQ ID NO: 737 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
gcggcacccucauaggccutt

SEQ ID NO: 738 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
aggccuaugagggugccgctt

SEQ ID NO: 739 - DNA, 21 bp, Artificial sequence
  siRNAs to PCSK9
  modified_base 2, 5, 7, 8, 9, 10, 11, 13, 17, 18, 19: /mod_base = "2'-deoxy-2'-fluoro corresponding base"
  modified_base 21: /mod_base = "5'-thio thymidine"
  modified_base 1, 3, 4, 6, 12, 14, 15, 16: /mod_base = "2'-hydroxy corresponding base"
gcggcacccucauaggccutt

SEQ ID NO: 740 - DNA, 21 bp, Artificial sequence
  siRNAs to PCSK9
  modified_base 4, 5, 6, 8, 14, 16, 17, 19: /mod_base = "2'-deoxy-2'-fluoro corresponding base"
  modified_base 21: /mod_base = "5'-thio thymidine"
  modified_base 1, 2, 3, 7, 9, 10, 11, 12, 13, 15, 18: /mod_base = "2'-hydroxy corresponding base"
aggccuaugagggugccgctt

SEQ ID NO: 741 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
gcggcacccucauaggccutt

SEQ ID NO: 742 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
aggccuaugagggugccgctt

SEQ ID NO: 743 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
gcggcacccucauaggccutt

SEQ ID NO: 744 - DNA, 21 bp, Artificial sequence
  siRNAs to PCSK9
  modified_base 4, 5, 6, 8, 14, 16, 17, 19: /mod_base = "2'-deoxy-2'-fluoro corresponding base"
  modified_base 21: /mod_base = "5'-thio thymidine"
  modified_base 1, 2, 3, 7, 9, 10, 11, 12, 13, 15, 18: /mod_base = "2'-hydroxy corresponding base"
aggccuaugagggugccgctt

SEQ ID NO: 745 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
gcggcacccucauaggccutt

SEQ ID NO: 746 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
aggccuaugagggugccgctt

SEQ ID NO: 747 - DNA, 21 bp, Artificial sequence
  siRNAs to PCSK9
  modified_base 2, 5, 7, 8, 9, 10, 11, 13, 17, 18, 19: /mod_base = "2'-deoxy-2'-fluoro corresponding base"
  modified_base 21: /mod_base = "5'-thio thymidine"
  modified_base 1, 3, 4, 6, 12, 14, 15, 16: /mod_base = "2'-hydroxy corresponding base"
gcggcacccucauaggccutt

SEQ ID NO: 748 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
aggccuaugagggugccgctt

SEQ ID NO: 749 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
gcggcacccucauaggccutt

SEQ ID NO: 750 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
aggccuaugagggugccgctt

SEQ ID NO: 751 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
aaggagcauggaaucccggtt

SEQ ID NO: 752 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ccgggauuccaugcuccuutt

SEQ ID NO: 753 - DNA, 21 bp, Artificial sequence
  siRNAs to PCSK9
  modified_base 7, 9, 14, 15, 16, 17: /mod_base = "2'-O-methyl corresponding base"
  modified_base 21: /mod_base = "5'-thio thymidine"
  modified_base 1, 2, 3, 4, 5, 6, 8, 10, 11, 12, 13, 18, 19: /mod_base = "2'-hydroxy corresponding base"
aaggagcauggaaucccggtt

SEQ ID NO: 754 - DNA, 21 bp, Artificial sequence
  siRNAs to PCSK9
  modified_base 10: /mod_base = "2'-O-methyl corresponding base"
  modified_base 21: /mod_base = "5'-thio thymidine"
  modified_base 1, 2, 3, 4, 5, 6, 7, 8, 9, 11, 12, 13, 14, 15, 16, 17, 18, 19: /mod_base = "2'-hydroxy corresponding base"
ccgggauuccaugcuccuutt

SEQ ID NO: 755 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
aggagcauggaaucccggctt

SEQ ID NO: 756 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gccgggauuccaugcuccutt

SEQ ID NO: 757 - DNA, 21 bp, Artificial sequence
  siRNAs to PCSK9
  modified_base 6, 8, 13, 14, 15, 16, 19: /mod_base = "2'-O-methyl corresponding base"
  modified_base 21: /mod_base = "5'-thio thymidine"
  modified_base 1, 2, 3, 4, 5, 7, 9, 10, 11, 12, 17, 18: /mod_base = "2'-hydroxy corresponding base"
aggagcauggaaucccggctt

SEQ ID NO: 758 - DNA, 21 bp, Artificial sequence
  siRNAs to PCSK9
  modified_base 11: /mod_base = "2'-O-methyl corresponding base"
  modified_base 21: /mod_base = "5'-thio thymidine"
  modified_base 1, 2, 3, 4, 5, 6, 7, 8, 9, 10, 12, 13, 14, 15, 16, 17, 18, 19: /mod_base = "2'-hydroxy corresponding base"
gccgggauuccaugcuccutt

SEQ ID NO: 759 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gagcauggaaucccggccctt

SEQ ID NO: 760 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gggccgggauuccaugcuctt

SEQ ID NO: 761 - DNA, 21 bp, Artificial sequence
  siRNAs to PCSK9
  modified_base 4, 6, 11, 12, 13, 14, 17, 18, 19: /mod_base = "2'-O-methyl corresponding base"
  modified_base 21: /mod_base = "5'-thio thymidine"
  modified_base 1, 2, 3, 5, 7, 8, 9, 10, 15, 16: /mod_base = "2'-hydroxy corresponding base"
gagcauggaaucccggccctt

SEQ ID NO: 762 - DNA, 21 bp, Artificial sequence
  siRNAs to PCSK9
  modified_base 13: /mod_base = "2'-O-methyl corresponding base"
  modified_base 21: /mod_base = "5'-thio thymidine"
  modified_base 1, 2, 3, 4, 5, 6, 7, 8, 9, 10, 11, 12, 14, 15, 16, 17, 18, 19: /mod_base = "2'-hydroxy corresponding base"
gggccgggauuccaugcuctt

SEQ ID NO: 763 - DNA, 21 bp, Artificial sequence
  siRNAs to PCSK9
  modified_base 1..19: /mod_base = "2'-hydroxy corresponding base"
gccuacgccguagacaacatt

SEQ ID NO: 764 - DNA, 21 bp, Artificial sequence
  siRNAs to PCSK9
  modified_base 1..19: /mod_base = "2'-hydroxy corresponding base"
uguugucuacggcguaggctt

SEQ ID NO: 765 - DNA, 21 bp, Artificial sequence
  siRNAs to PCSK9
  modified_base 1..19: /mod_base = "2'-hydroxy corresponding base"
ccuacgccguagacaacactt

SEQ ID NO: 766 - DNA, 21 bp, Artificial sequence
  siRNAs to PCSK9
  modified_base 1..19: /mod_base = "2'-hydroxy corresponding base"
guguugucuacggcguaggtt

SEQ ID NO: 767 - DNA, 21 bp, Artificial sequence
  siRNAs to PCSK9
  modified_base 1..19: /mod_base = "2'-hydroxy corresponding base"
cuacgccguagacaacacgtt

SEQ ID NO: 768 - DNA, 21 bp, Artificial sequence
  siRNAs to PCSK9
  modified_base 1..19: /mod_base = "2'-hydroxy corresponding base"
cguguugucuacggcguagtt

SEQ ID NO: 769 - DNA, 21 bp, Artificial sequence
  siRNAs to PCSK9
  modified_base 1..19: /mod_base = "2'-hydroxy corresponding base"
uacgccguagacaacacgutt

SEQ ID NO: 770 - DNA, 21 bp, Artificial sequence
  siRNAs to PCSK9
  modified_base 1..19: /mod_base = "2'-hydroxy corresponding base"
acguguugucuacggcguatt

SEQ ID NO: 771 - DNA, 21 bp, Artificial sequence
  siRNAs to PCSK9
  modified_base 1..19: /mod_base = "2'-hydroxy corresponding base"
cgccguagacaacacgugutt

SEQ ID NO: 772 - DNA, 21 bp, Artificial sequence
  siRNAs to PCSK9
  modified_base 1..19: /mod_base = "2'-hydroxy corresponding base"
acacguguugucuacggcgtt

SEQ ID NO: 773 - DNA, 21 bp, Artificial sequence
  siRNAs to PCSK9
  modified_base 1..19: /mod_base = "2'-hydroxy corresponding base"
gccguagacaacacgugugtt

SEQ ID NO: 774 - DNA, 21 bp, Artificial sequence
  siRNAs to PCSK9
  modified_base 1..19: /mod_base = "2'-hydroxy corresponding base"
cacacguguugucuacggctt

SEQ ID NO: 775 - DNA, 21 bp, Artificial sequence
  siRNAs to PCSK9
  modified_base 1..19: /mod_base = "2'-hydroxy corresponding base"
ccguagacaacacgugugutt

SEQ ID NO: 776 - DNA, 21 bp, Artificial sequence
  siRNAs to PCSK9
  modified_base 1..19: /mod_base = "2'-hydroxy corresponding base"
acacacguguugucuacggtt

SEQ ID NO: 777 - DNA, 21 bp, Artificial sequence
  siRNAs to PCSK9
  modified_base 1..19: /mod_base = "2'-hydroxy corresponding base"
cguagacaacacguguguatt

SEQ ID NO: 778 - DNA, 21 bp, Artificial sequence
  siRNAs to PCSK9
  modified_base 1..19: /mod_base = "2'-hydroxy corresponding base"
uacacacguguugucuacgtt

SEQ ID NO: 779 - DNA, 21 bp, Artificial sequence
  siRNAs to PCSK9
  modified_base 1..19: /mod_base = "2'-hydroxy corresponding base"
uagacaacacguguguagutt

SEQ ID NO: 780 - DNA, 21 bp, Artificial sequence
  siRNAs to PCSK9
  modified_base 1..19: /mod_base = "2'-hydroxy corresponding base"
acuacacacguguugucuatt

SEQ ID NO: 781 - DNA, 21 bp, Artificial sequence
  siRNAs to PCSK9
  modified_base 1..19: /mod_base = "2'-hydroxy corresponding base"
agacaacacguguguaguctt

SEQ ID NO: 782 - DNA, 21 bp, Artificial sequence
  siRNAs to PCSK9
  modified_base 1..19: /mod_base = "2'-hydroxy corresponding base"
gacuacacacguguugucutt

SEQ ID NO: 783 - DNA, 21 bp, Artificial sequence
  siRNAs to PCSK9
  modified_base 1..19: /mod_base = "2'-hydroxy corresponding base"
gacaacacguguguagucatt

SEQ ID NO: 784 - DNA, 21 bp, Artificial sequence
  siRNAs to PCSK9
  modified_base 1..19: /mod_base = "2'-hydroxy corresponding base"
ugacuacacacguguuguctt

SEQ ID NO: 785 - DNA, 21 bp, Artificial sequence
  siRNAs to PCSK9
  modified_base 1..19: /mod_base = "2'-hydroxy corresponding base"
acaacacguguguagucagtt

SEQ ID NO: 786 - DNA, 21 bp, Artificial sequence
  siRNAs to PCSK9
  modified_base 1..19: /mod_base = "2'-hydroxy corresponding base"
cugacuacacacguguugutt

SEQ ID NO: 787 - DNA, 21 bp, Artificial sequence
  siRNAs to PCSK9
  modified_base 1..19: /mod_base = "2'-hydroxy corresponding base"
caacacguguguagucaggtt

SEQ ID NO: 788 - DNA, 21 bp, Artificial sequence
  siRNAs to PCSK9
  modified_base 1..19: /mod_base = "2'-hydroxy corresponding base"
ccugacuacacacguguugtt

SEQ ID NO: 789 - DNA, 21 bp, Artificial sequence
  siRNAs to PCSK9
  modified_base 1..19: /mod_base = "2'-hydroxy corresponding base"
cacguguguagucaggagctt

SEQ ID NO: 790 - DNA, 21 bp, Artificial sequence
  siRNAs to PCSK9
  modified_base 1..19: /mod_base = "2'-hydroxy corresponding base"
gcuccugacuacacacgugtt

SEQ ID NO: 791 - DNA, 21 bp, Artificial sequence
  siRNAs to PCSK9
  modified_base 1..19: /mod_base = "2'-hydroxy corresponding base"
acguguguagucaggagcctt

SEQ ID NO: 792 - DNA, 21 bp, Artificial sequence
  siRNAs to PCSK9
  modified_base 1..19: /mod_base = "2'-hydroxy corresponding base"
ggcuccugacuacacacgutt

SEQ ID NO: 793 - DNA, 21 bp, Artificial sequence
  siRNAs to PCSK9
  modified_base 1..19: /mod_base = "2'-hydroxy corresponding base"
cguguguagucaggagccgtt

SEQ ID NO: 794 - DNA, 21 bp, Artificial sequence
  siRNAs to PCSK9
  modified_base 1..19: /mod_base = "2'-hydroxy corresponding base"
cggcuccugacuacacacgtt

SEQ ID NO: 795 - DNA, 21 bp, Artificial sequence
  siRNAs to PCSK9
  modified_base 1..19: /mod_base = "2'-hydroxy corresponding base"
uguguagucaggagccgggtt

SEQ ID NO: 796 - DNA, 21 bp, Artificial sequence
  siRNAs to PCSK9
  modified_base 1..19: /mod_base = "2'-hydroxy corresponding base"
cccggcuccugacuacacatt

SEQ ID NO: 797 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gucaggagccgggacgucatt

SEQ ID NO: 798 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ugacgucccggcuccugactt

SEQ ID NO: 799 - DNA, 21 bp, Artificial sequence
  siRNAs to PCSK9
  modified_base 2, 3, 9, 10, 15, 17, 18: /mod_base = "2'-O-methyl corresponding base"
  modified_base 21: /mod_base = "5'-thio thymidine"
  modified_base 1, 4, 5, 6, 7, 8, 11, 12, 13, 14, 16, 19: /mod_base = "2'-hydroxy corresponding base"
gucaggagccgggacgucatt

SEQ ID NO: 800 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ugacgucccggcuccugactt

SEQ ID NO: 801 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ucaggagccgggacgucagtt

SEQ ID NO: 802 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cugacgucccggcuccugatt

SEQ ID NO: 803 - DNA, 21 bp, Artificial sequence
  siRNAs to PCSK9
  modified_base 1, 2, 8, 9, 14, 16, 17: /mod_base = "2'-O-methyl corresponding base"
  modified_base 21: /mod_base = "5'-thio thymidine"
  modified_base 3, 4, 5, 6, 7, 10, 11, 12, 13, 15, 18, 19: /mod_base = "2'-hydroxy corresponding base"
ucaggagccgggacgucagtt

SEQ ID NO: 804 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cugacgucccggcuccugatt

SEQ ID NO: 805 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
caggagccgggacgucagctt

SEQ ID NO: 806 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gcugacgucccggcuccugtt

SEQ ID NO: 807 - DNA, 21 bp, Artificial sequence
  siRNAs to PCSK9
  modified_base 1, 7, 8, 13, 15, 16, 19: /mod_base = "2'-O-methyl corresponding base"
  modified_base 21: /mod_base = "5'-thio thymidine"
  modified_base 2, 3, 4, 5, 6, 9, 10, 11, 12, 14, 17, 18: /mod_base = "2'-hydroxy corresponding base"
caggagccgggacgucagctt

SEQ ID NO: 808 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gcugacgucccggcuccugtt

SEQ ID NO: 809 - DNA, 21 bp, Artificial sequence
  siRNAs to PCSK9
  modified_base 1..19: /mod_base = "2'-hydroxy corresponding base"
agccgggacgucagcacuatt

SEQ ID NO: 810 - DNA, 21 bp, Artificial sequence
  siRNAs to PCSK9
  modified_base 1..19: /mod_base = "2'-hydroxy corresponding base"
uagugcugacgucccggcutt

SEQ ID NO: 811 - DNA, 21 bp, Artificial sequence
  siRNAs to PCSK9
  modified_base 1..19: /mod_base = "2'-hydroxy corresponding base"
ccgggacgucagcacuacatt

SEQ ID NO: 812 - DNA, 21 bp, Artificial sequence
  siRNAs to PCSK9
  modified_base 1..19: /mod_base = "2'-hydroxy corresponding base"
uguagugcugacgucccggtt

SEQ ID NO: 813 - DNA, 21 bp, Artificial sequence
  siRNAs to PCSK9
  modified_base 1..19: /mod_base = "2'-hydroxy corresponding base"
ccgugacagccguugccautt

SEQ ID NO: 814 - DNA, 21 bp, Artificial sequence
  siRNAs to PCSK9
  modified_base 1..19: /mod_base = "2'-hydroxy corresponding base"
auggcaacggcugucacggtt

SEQ ID NO: 815 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gccaucugcugccggagcctt

SEQ ID NO: 816 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ggcuccggcagcagauggctt

SEQ ID NO: 817 - DNA, 21 bp, Artificial sequence
  siRNAs to PCSK9
  modified_base 1..19: /mod_base = "2'-hydroxy corresponding base"
cccaucccaggaugggugutt

SEQ ID NO: 818 - DNA, 21 bp, Artificial sequence
  siRNAs to PCSK9
  modified_base 1..19: /mod_base = "2'-hydroxy corresponding base"
acacccauccugggaugggtt

SEQ ID NO: 819 - DNA, 21 bp, Artificial sequence
  siRNAs to PCSK9
  modified_base 1..19: /mod_base = "2'-hydroxy corresponding base"
caucccaggaugggugucutt

SEQ ID NO: 820 - DNA, 21 bp, Artificial sequence
  siRNAs to PCSK9
  modified_base 1..19: /mod_base = "2'-hydroxy corresponding base"
agacacccauccugggaugtt

SEQ ID NO: 821 - DNA, 21 bp, Artificial sequence
  siRNAs to PCSK9
  modified_base 1..19: /mod_base = "2'-hydroxy corresponding base"
agcuuuaaaaugguuccgatt

SEQ ID NO: 822 - DNA, 21 bp, Artificial sequence
  siRNAs to PCSK9
  modified_base 1..19: /mod_base = "2'-hydroxy corresponding base"
ucggaaccauuuuaaagcutt

SEQ ID NO: 823 - DNA, 21 bp, Artificial sequence
  siRNAs to PCSK9
  modified_base 1..19: /mod_base = "2'-hydroxy corresponding base"
gcuuuaaaaugguuccgactt

SEQ ID NO: 824 - DNA, 21 bp, Artificial sequence
  siRNAs to PCSK9
  modified_base 1..19: /mod_base = "2'-hydroxy corresponding base"
gucggaaccauuuuaaagctt

SEQ ID NO: 825 - DNA, 21 bp, Artificial sequence
  siRNAs to PCSK9
  modified_base 1..19: /mod_base = "2'-hydroxy corresponding base"
cuuuaaaaugguuccgacutt

SEQ ID NO: 826 - DNA, 21 bp, Artificial sequence
  siRNAs to PCSK9
  modified_base 1..19: /mod_base = "2'-hydroxy corresponding base"
agucggaaccauuuuaaagtt

SEQ ID NO: 827 - DNA, 21 bp, Artificial sequence
  siRNAs to PCSK9
  modified_base 1..19: /mod_base = "2'-hydroxy corresponding base"
uuuaaaaugguuccgacuutt

SEQ ID NO: 828 - DNA, 21 bp, Artificial sequence
  siRNAs to PCSK9
  modified_base 1..19: /mod_base = "2'-hydroxy corresponding base"
aagucggaaccauuuuaaatt

SEQ ID NO: 829 - DNA, 21 bp, Artificial sequence
  siRNAs to PCSK9
  modified_base 1..19: /mod_base = "2'-hydroxy corresponding base"
uuaaaaugguuccgacuugtt

SEQ ID NO: 830 - DNA, 21 bp, Artificial sequence
  siRNAs to PCSK9
  modified_base 1..19: /mod_base = "2'-hydroxy corresponding base"
caagucggaaccauuuuaatt

SEQ ID NO: 831 - DNA, 21 bp, Artificial sequence
  siRNAs to PCSK9
  modified_base 1..19: /mod_base = "2'-hydroxy corresponding base"
uaaaaugguuccgacuugutt

SEQ ID NO: 832 - DNA, 21 bp, Artificial sequence
  siRNAs to PCSK9
  modified_base 1..19: /mod_base = "2'-hydroxy corresponding base"
acaagucggaaccauuuuatt

SEQ ID NO: 833 - DNA, 21 bp, Artificial sequence
  siRNAs to PCSK9
  modified_base 1..19: /mod_base = "2'-hydroxy corresponding base"
aaaaugguuccgacuuguctt

SEQ ID NO: 834 - DNA, 21 bp, Artificial sequence
  siRNAs to PCSK9
  modified_base 1..19: /mod_base = "2'-hydroxy corresponding base"
gacaagucggaaccauuuutt

SEQ ID NO: 835 - DNA, 21 bp, Artificial sequence
  siRNAs to PCSK9
  modified_base 1..19: /mod_base = "2'-hydroxy corresponding base"
aaaugguuccgacuugucctt

SEQ ID NO: 836 - DNA, 21 bp, Artificial sequence
  siRNAs to PCSK9
  modified_base 1..19: /mod_base = "2'-hydroxy corresponding base"
ggacaagucggaaccauuutt

SEQ ID NO: 837 - DNA, 21 bp, Artificial sequence
  siRNAs to PCSK9
  modified_base 1..19: /mod_base = "2'-hydroxy corresponding base"
aaugguuccgacuuguccctt

SEQ ID NO: 838 - DNA, 21 bp, Artificial sequence
  siRNAs to PCSK9
  modified_base 1..19: /mod_base = "2'-hydroxy corresponding base"
gggacaagucggaaccauutt

SEQ ID NO: 839 - DNA, 21 bp, Artificial sequence
  siRNAs to PCSK9
  modified_base 1..19: /mod_base = "2'-hydroxy corresponding base"
gguuccgacuugucccucutt

SEQ ID NO: 840 - DNA, 21 bp, Artificial sequence
  siRNAs to PCSK9
  modified_base 1..19: /mod_base = "2'-hydroxy corresponding base"
agagggacaagucggaacctt

SEQ ID NO: 841 - DNA, 21 bp, Artificial sequence
  siRNAs to PCSK9
  modified_base 1..19: /mod_base = "2'-hydroxy corresponding base"
cuccauggccuggcacgagtt

SEQ ID NO: 842 - DNA, 21 bp, Artificial sequence
  siRNAs to PCSK9
  modified_base 1..19: /mod_base = "2'-hydroxy corresponding base"
cucgugccaggccauggagtt

SEQ ID NO: 843 - DNA, 21 bp, Artificial sequence
  siRNAs to PCSK9
  modified_base 1..19: /mod_base = "2'-hydroxy corresponding base"
ccauggccuggcacgagggtt

SEQ ID NO: 844 - DNA, 21 bp, Artificial sequence
  siRNAs to PCSK9
  modified_base 1..19: /mod_base = "2'-hydroxy corresponding base"
cccucgugccaggccauggtt

SEQ ID NO: 845 - DNA, 21 bp, Artificial sequence
  siRNAs to PCSK9
  modified_base 1..19: /mod_base = "2'-hydroxy corresponding base"
gaacucacucacucugggutt

SEQ ID NO: 846 - DNA, 21 bp, Artificial sequence
  siRNAs to PCSK9
  modified_base 1..19: /mod_base = "2'-hydroxy corresponding base"
acccagagugagugaguuctt

SEQ ID NO: 847 - DNA, 21 bp, Artificial sequence
  siRNAs to PCSK9
  modified_base 1..19: /mod_base = "2'-hydroxy corresponding base"
ucacucacucugggugccutt

SEQ ID NO: 848 - DNA, 21 bp, Artificial sequence
  siRNAs to PCSK9
  modified_base 1..19: /mod_base = "2'-hydroxy corresponding base"
aggcacccagagugagugatt

SEQ ID NO: 849 - DNA, 21 bp, Artificial sequence
  siRNAs to PCSK9
  modified_base 1..19: /mod_base = "2'-hydroxy corresponding base"
uuucaccauucaaacaggutt

SEQ ID NO: 850 - DNA, 21 bp, Artificial sequence
  siRNAs to PCSK9
  modified_base 1..19: /mod_base = "2'-hydroxy corresponding base"
accuguuugaauggugaaatt

SEQ ID NO: 851 - DNA, 21 bp, Artificial sequence
  siRNAs to PCSK9
  modified_base 1..19: /mod_base = "2'-hydroxy corresponding base"
cauucaaacaggucgagcutt

SEQ ID NO: 852 - DNA, 21 bp, Artificial sequence
  siRNAs to PCSK9
  modified_base 1..19: /mod_base = "2'-hydroxy corresponding base"
agcucgaccuguuugaaugtt

SEQ ID NO: 853 - DNA, 21 bp, Artificial sequence
  siRNAs to PCSK9
  modified_base 1..19: /mod_base = "2'-hydroxy corresponding base"
auucaaacaggucgagcugtt

SEQ ID NO: 854 - DNA, 21 bp, Artificial sequence
  siRNAs to PCSK9
  modified_base 1..19: /mod_base = "2'-hydroxy corresponding base"
cagcucgaccuguuugaautt

SEQ ID NO: 855 - DNA, 21 bp, Artificial sequence
  siRNAs to PCSK9
  modified_base 1..19: /mod_base = "2'-hydroxy corresponding base"
uucaaacaggucgagcugutt

SEQ ID NO: 856 - DNA, 21 bp, Artificial sequence
  siRNAs to PCSK9
  modified_base 1..19: /mod_base = "2'-hydroxy corresponding base"
acagcucgaccuguuugaatt

SEQ ID NO: 857 - DNA, 21 bp, Artificial sequence
  siRNAs to PCSK9
  modified_base 1..19: /mod_base = "2'-hydroxy corresponding base"
ucaaacaggucgagcugugtt

SEQ ID NO: 858 - DNA, 21 bp, Artificial sequence
  siRNAs to PCSK9
  modified_base 1..19: /mod_base = "2'-hydroxy corresponding base"
cacagcucgaccuguuugatt

SEQ ID NO: 859 - DNA, 21 bp, Artificial sequence
  siRNAs to PCSK9
  modified_base 1..19: /mod_base = "2'-hydroxy corresponding base"
caaacaggucgagcugugctt

SEQ ID NO: 860 - DNA, 21 bp, Artificial sequence
  siRNAs to PCSK9
  modified_base 1..19: /mod_base = "2'-hydroxy corresponding base"
gcacagcucgaccuguuugtt

SEQ ID NO: 861 - DNA, 21 bp, Artificial sequence
  siRNAs to PCSK9
  modified_base 1..19: /mod_base = "2'-hydroxy corresponding base"
aaacaggucgagcugugcutt

SEQ ID NO: 862 - DNA, 21 bp, Artificial sequence
  siRNAs to PCSK9
  modified_base 1..19: /mod_base = "2'-hydroxy corresponding base"
agcacagcucgaccuguuutt

SEQ ID NO: 863 - DNA, 21 bp, Artificial sequence
  siRNAs to PCSK9
  modified_base 1..19: /mod_base = "2'-hydroxy corresponding base"
aacaggucgagcugugcuctt

SEQ ID NO: 864 - DNA, 21 bp, Artificial sequence
  siRNAs to PCSK9
  modified_base 1..19: /mod_base = "2'-hydroxy corresponding base"
gagcacagcucgaccuguutt

SEQ ID NO: 865 - DNA, 21 bp, Artificial sequence
  siRNAs to PCSK9
  modified_base 1..19: /mod_base = "2'-hydroxy corresponding base"
caggucgagcugugcucggtt

SEQ ID NO: 866 - DNA, 21 bp, Artificial sequence
  siRNAs to PCSK9
  modified_base 1..19: /mod_base = "2'-hydroxy corresponding base"
ccgagcacagcucgaccugtt

SEQ ID NO: 867 - DNA, 21 bp, Artificial sequence
  siRNAs to PCSK9
  modified_base 1..19: /mod_base = "2'-hydroxy corresponding base"
aggucgagcugugcucgggtt

SEQ ID NO: 868 - DNA, 21 bp, Artificial sequence
  siRNAs to PCSK9
  modified_base 1..19: /mod_base = "2'-hydroxy corresponding base"
cccgagcacagcucgaccutt

SEQ ID NO: 869 - DNA, 21 bp, Artificial sequence
  siRNAs to PCSK9
  modified_base 1..19: /mod_base = "2'-hydroxy corresponding base"
gucgagcugugcucgggugtt

SEQ ID NO: 870 - DNA, 21 bp, Artificial sequence
  siRNAs to PCSK9
  modified_base 1..19: /mod_base = "2'-hydroxy corresponding base"
cacccgagcacagcucgactt

SEQ ID NO: 871 - DNA, 21 bp, Artificial sequence
  siRNAs to PCSK9
  modified_base 1..19: /mod_base = "2'-hydroxy corresponding base"
ucgagcugugcucgggugctt

SEQ ID NO: 872 - DNA, 21 bp, Artificial sequence
  siRNAs to PCSK9
  modified_base 1..19: /mod_base = "2'-hydroxy corresponding base"
gcacccgagcacagcucgatt

SEQ ID NO: 873 - DNA, 21 bp, Artificial sequence
  siRNAs to PCSK9
  modified_base 1..19: /mod_base = "2'-hydroxy corresponding base"
agcugcucccaaugugccgtt

SEQ ID NO: 874 - DNA, 21 bp, Artificial sequence
  siRNAs to PCSK9
  modified_base 1..19: /mod_base = "2'-hydroxy corresponding base"
cggcacauugggagcagcutt

SEQ ID NO: 875 - DNA, 21 bp, Artificial sequence
  siRNAs to PCSK9
  modified_base 1..19: /mod_base = "2'-hydroxy corresponding base"
gcugcucccaaugugccgatt

SEQ ID NO: 876 - DNA, 21 bp, Artificial sequence
  siRNAs to PCSK9
  modified_base 1..19: /mod_base = "2'-hydroxy corresponding base"
ucggcacauugggagcagctt

SEQ ID NO: 877 - DNA, 21 bp, Artificial sequence
  siRNAs to PCSK9
  modified_base 1..19: /mod_base = "2'-hydroxy corresponding base"
ugcucccaaugugccgaugtt

SEQ ID NO: 878 - DNA, 21 bp, Artificial sequence
  siRNAs to PCSK9
  modified_base 1..19: /mod_base = "2'-hydroxy corresponding base"
caucggcacauugggagcatt

SEQ ID NO: 879 - DNA, 21 bp, Artificial sequence
  siRNAs to PCSK9
  modified_base 1..19: /mod_base = "2'-hydroxy corresponding base"
ucccaaugugccgaugucctt

SEQ ID NO: 880 - DNA, 21 bp, Artificial sequence
  siRNAs to PCSK9
  modified_base 1..19: /mod_base = "2'-hydroxy corresponding base"
ggacaucggcacauugggatt

SEQ ID NO: 881 - DNA, 21 bp, Artificial sequence
  siRNAs to PCSK9
  modified_base 1..19: /mod_base = "2'-hydroxy corresponding base"
ccaaugugccgauguccgutt

SEQ ID NO: 882 - DNA, 21 bp, Artificial sequence
  siRNAs to PCSK9
  modified_base 1..19: /mod_base = "2'-hydroxy corresponding base"
acggacaucggcacauuggtt

SEQ ID NO: 883 - DNA, 21 bp, Artificial sequence
  siRNAs to PCSK9
  modified_base 1..19: /mod_base = "2'-hydroxy corresponding base"
caaugugccgauguccgugtt

SEQ ID NO: 884 - DNA, 21 bp, Artificial sequence
  siRNAs to PCSK9
  modified_base 1..19: /mod_base = "2'-hydroxy corresponding base"
cacggacaucggcacauugtt

SEQ ID NO: 885 - DNA, 21 bp, Artificial sequence
  siRNAs to PCSK9
  modified_base 1..19: /mod_base = "2'-hydroxy corresponding base"
aaugugccgauguccguggtt

SEQ ID NO: 886 - DNA, 21 bp, Artificial sequence
  siRNAs to PCSK9
  modified_base 1..19: /mod_base = "2'-hydroxy corresponding base"
ccacggacaucggcacauutt

SEQ ID NO: 887 - DNA, 21 bp, Artificial sequence
  siRNAs to PCSK9
  modified_base 1..19: /mod_base = "2'-hydroxy corresponding base"
ccgauguccgugggcagaatt

SEQ ID NO: 888 - DNA, 21 bp, Artificial sequence
  siRNAs to PCSK9
  modified_base 1..19: /mod_base = "2'-hydroxy corresponding base"
uucugcccacggacaucggtt

SEQ ID NO: 889 - DNA, 21 bp, Artificial sequence
  siRNAs to PCSK9
  modified_base 1..19: /mod_base = "2'-hydroxy corresponding base"
gauguccgugggcagaaugtt

SEQ ID NO: 890 - DNA, 21 bp, Artificial sequence
  siRNAs to PCSK9
  modified_base 1..19: /mod_base = "2'-hydroxy corresponding base"
cauucugcccacggacauctt

SEQ ID NO: 891 - DNA, 21 bp, Artificial sequence
  siRNAs to PCSK9
  modified_base 1..19: /mod_base = "2'-hydroxy corresponding base"
guccgugggcagaaugacutt

SEQ ID NO: 892 - DNA, 21 bp, Artificial sequence
  siRNAs to PCSK9
  modified_base 1..19: /mod_base = "2'-hydroxy corresponding base"
agucauucugcccacggactt

SEQ ID NO: 893 - DNA, 21 bp, Artificial sequence
  siRNAs to PCSK9
  modified_base 1..19: /mod_base = "2'-hydroxy corresponding base"
uccgugggcagaaugacuutt

SEQ ID NO: 894 - DNA, 21 bp, Artificial sequence
  siRNAs to PCSK9
  modified_base 1..19: /mod_base = "2'-hydroxy corresponding base"
aagucauucugcccacggatt

SEQ ID NO: 895 - DNA, 21 bp, Artificial sequence
  siRNAs to PCSK9
  modified_base 1..19: /mod_base = "2'-hydroxy corresponding base"
ugggcagaaugacuuuuautt

SEQ ID NO: 896 - DNA, 21 bp, Artificial sequence
  siRNAs to PCSK9
  modified_base 1..19: /mod_base = "2'-hydroxy corresponding base"
auaaaagucauucugcccatt

SEQ ID NO: 897 - DNA, 21 bp, Artificial sequence
  siRNAs to PCSK9
  modified_base 1..19: /mod_base = "2'-hydroxy corresponding base"
acuuuuauugagcucuugutt

SEQ ID NO: 898 - DNA, 21 bp, Artificial sequence
  siRNAs to PCSK9
  modified_base 1..19: /mod_base = "2'-hydroxy corresponding base"
acaagagcucaauaaaagutt

SEQ ID NO: 899 - DNA, 21 bp, Artificial sequence
  siRNAs to PCSK9
  modified_base 1..19: /mod_base = "2'-hydroxy corresponding base"
auugagcucuuguuccgugtt

SEQ ID NO: 900 - DNA, 21 bp, Artificial sequence
  siRNAs to PCSK9
  modified_base 1..19: /mod_base = "2'-hydroxy corresponding base"
cacggaacaagagcucaautt

SEQ ID NO: 901 - DNA, 21 bp, Artificial sequence
  siRNAs to PCSK9
  modified_base 1..19: /mod_base = "2'-hydroxy corresponding base"
agcucuuguuccgugccagtt

SEQ ID NO: 902 - DNA, 21 bp, Artificial sequence
  siRNAs to PCSK9
  modified_base 1..19: /mod_base = "2'-hydroxy corresponding base"
cuggcacggaacaagagcutt

SEQ ID NO: 903 - DNA, 21 bp, Artificial sequence
  siRNAs to PCSK9
  modified_base 1..19: /mod_base = "2'-hydroxy corresponding base"
gcucuuguuccgugccaggtt

SEQ ID NO: 904 - DNA, 21 bp, Artificial sequence
  siRNAs to PCSK9
  modified_base 1..19: /mod_base = "2'-hydroxy corresponding base"
ccuggcacggaacaagagctt

SEQ ID NO: 905 - DNA, 21 bp, Artificial sequence
  siRNAs to PCSK9
  modified_base 1..19: /mod_base = "2'-hydroxy corresponding base"
uguuccgugccaggcauuctt

SEQ ID NO: 906 - DNA, 21 bp, Artificial sequence
  siRNAs to PCSK9
  modified_base 1..19: /mod_base = "2'-hydroxy corresponding base"
gaaugccuggcacggaacatt

SEQ ID NO: 907 - DNA, 21 bp, Artificial sequence
  siRNAs to PCSK9
  modified_base 1..19: /mod_base = "2'-hydroxy corresponding base"
guuccgugccaggcauucatt

SEQ ID NO: 908 - DNA, 21 bp, Artificial sequence
  siRNAs to PCSK9
  modified_base 1..19: /mod_base = "2'-hydroxy corresponding base"
ugaaugccuggcacggaactt

SEQ ID NO: 909 - DNA, 21 bp, Artificial sequence
  siRNAs to PCSK9
  modified_base 1..19: /mod_base = "2'-hydroxy corresponding base"
uuccgugccaggcauucaatt

SEQ ID NO: 910 - DNA, 21 bp, Artificial sequence
  siRNAs to PCSK9
  modified_base 1..19: /mod_base = "2'-hydroxy corresponding base"
uugaaugccuggcacggaatt

SEQ ID NO: 911 - DNA, 21 bp, Artificial sequence
  siRNAs to PCSK9
  modified_base 1..19: /mod_base = "2'-hydroxy corresponding base"
cgugccaggcauucaaucctt

SEQ ID NO: 912 - DNA, 21 bp, Artificial sequence
  siRNAs to PCSK9
  modified_base 1..19: /mod_base = "2'-hydroxy corresponding base"
ggauugaaugccuggcacgtt

SEQ ID NO: 913 - DNA, 21 bp, Artificial sequence
  siRNAs to PCSK9
  modified_base 1..19: /mod_base = "2'-hydroxy corresponding base"
gugccaggcauucaauccutt

SEQ ID NO: 914 - DNA, 21 bp, Artificial sequence
  siRNAs to PCSK9
  modified_base 1..19: /mod_base = "2'-hydroxy corresponding base"
aggauugaaugccuggcactt

SEQ ID NO: 915 - DNA, 21 bp, Artificial sequence
  siRNAs to PCSK9
  modified_base 1..19: /mod_base = "2'-hydroxy corresponding base"
caauccucaggucuccacctt

SEQ ID NO: 916 - DNA, 21 bp, Artificial sequence
  siRNAs to PCSK9
  modified_base 1..19: /mod_base = "2'-hydroxy corresponding base"
gguggagaccugaggauugtt

SEQ ID NO: 917 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
caccaaggaggcaggauuctt

SEQ ID NO: 918 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gaauccugccuccuuggugtt

SEQ ID NO: 919 - DNA, 21 bp, Artificial sequence
  siRNAs to PCSK9
  modified_base 1, 3, 4, 12, 17, 18, 19: /mod_base = "2'-O-methyl corresponding base"
  modified_base 21: /mod_base = "5'-thio thymidine"
  modified_base 2, 5, 6, 7, 8, 9, 10, 11, 13, 14, 15, 16: /mod_base = "2'-hydroxy corresponding base"
caccaaggaggcaggauuctt

SEQ ID NO: 920 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gaauccugccuccuuggugtt

SEQ ID NO: 921 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
caccaaggaggcaggauuctt

SEQ ID NO: 922 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
gaauccugccuccuuggugtt

SEQ ID NO: 923 - DNA, 21 bp, Artificial sequence
  siRNAs to PCSK9
  modified_base 1, 3, 4, 12, 17, 18, 19: /mod_base = "2'-deoxy-2'-fluoro corresponding base"
  modified_base 21: /mod_base = "5'-thio thymidine"
  modified_base 2, 5, 6, 7, 8, 9, 10, 11, 13, 14, 15, 16: /mod_base = "2'-hydroxy corresponding base"
caccaaggaggcaggauuctt

SEQ ID NO: 924 - DNA, 21 bp, Artificial sequence
  siRNAs to PCSK9
  modified_base 4, 5, 6, 7, 9, 10, 11, 12, 13, 14, 15, 18: /mod_base = "2'-deoxy-2'-fluoro corresponding base"
  modified_base 21: /mod_base = "5'-thio thymidine"
  modified_base 1, 2, 3, 8, 16, 17, 19: /mod_base = "2'-hydroxy corresponding base"
gaauccugccuccuuggugtt

SEQ ID NO: 925 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
caccaaggaggcaggauuctt

SEQ ID NO: 926 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
gaauccugccuccuuggugtt

SEQ ID NO: 927 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
caccaaggaggcaggauuctt

SEQ ID NO: 928 - DNA, 21 bp, Artificial sequence
  siRNAs to PCSK9
  modified_base 4, 5, 6, 7, 9, 10, 11, 12, 13, 14, 15, 18: /mod_base = "2'-deoxy-2'-fluoro corresponding base"
  modified_base 21: /mod_base = "5'-thio thymidine"
  modified_base 1, 2, 3, 8, 16, 17, 19: /mod_base = "2'-hydroxy corresponding base"
gaauccugccuccuuggugtt

SEQ ID NO: 929 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
caccaaggaggcaggauuctt

SEQ ID NO: 930 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
gaauccugccuccuuggugtt

SEQ ID NO: 931 - DNA, 21 bp, Artificial sequence
  siRNAs to PCSK9
  modified_base 1, 3, 4, 12, 17, 18, 19: /mod_base = "2'-deoxy-2'-fluoro corresponding base"
  modified_base 21: /mod_base = "5'-thio thymidine"
  modified_base 2, 5, 6, 7, 8, 9, 10, 11, 13, 14, 15, 16: /mod_base = "2'-hydroxy corresponding base"
caccaaggaggcaggauuctt

SEQ ID NO: 932 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
gaauccugccuccuuggugtt

SEQ ID NO: 933 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
caccaaggaggcaggauuctt

SEQ ID NO: 934 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
gaauccugccuccuuggugtt

SEQ ID NO: 935 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
ggccuggaguuuauucggatt

SEQ ID NO: 936 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
uccgaauaaacuccaggcctt

SEQ ID NO: 937 - DNA, 21 bp, Artificial sequence
  siRNAs to PCSK9
  modified_base 3, 4, 5, 10, 11, 12, 14, 15, 16: /mod_base = "2'-deoxy-2'-fluoro corresponding base"
  modified_base 21: /mod_base = "5'-thio thymidine"
  modified_base 1, 2, 6, 7, 8, 9, 13, 17, 18, 19: /mod_base = "2'-hydroxy corresponding base"
ggccuggaguuuauucggatt

SEQ ID NO: 938 - DNA, 21 bp, Artificial sequence
  siRNAs to PCSK9
  modified_base 1, 2, 3, 7, 11, 12, 13, 14, 18, 19: /mod_base = "2'-deoxy-2'-fluoro corresponding base"
  modified_base 21: /mod_base = "5'-thio thymidine"
  modified_base 4, 5, 6, 8, 9, 10, 15, 16, 17: /mod_base = "2'-hydroxy corresponding base"
uccgaauaaacuccaggcctt

SEQ ID NO: 939 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ggccuggaguuuauucggatt

SEQ ID NO: 940 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
uccgaauaaacuccaggcctt

SEQ ID NO: 941 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ggccuggaguuuauucggatt

SEQ ID NO: 942 - DNA, 21 bp, Artificial sequence
  siRNAs to PCSK9
  modified_base 1, 2, 3, 7, 11, 12, 13, 14, 18, 19: /mod_base = "2'-deoxy-2'-fluoro corresponding base"
  modified_base 21: /mod_base = "5'-thio thymidine"
  modified_base 4, 5, 6, 8, 9, 10, 15, 16, 17: /mod_base = "2'-hydroxy corresponding base"
uccgaauaaacuccaggcctt

SEQ ID NO: 943 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
ggccuggaguuuauucggatt

SEQ ID NO: 944 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
uccgaauaaacuccaggcctt

SEQ ID NO: 945 - DNA, 21 bp, Artificial sequence
  siRNAs to PCSK9
  modified_base 3, 4, 5, 10, 11, 12, 14, 15, 16: /mod_base = "2'-deoxy-2'-fluoro corresponding base"
  modified_base 21: /mod_base = "5'-thio thymidine"
  modified_base 1, 2, 6, 7, 8, 9, 13, 17, 18, 19: /mod_base = "2'-hydroxy corresponding base"
ggccuggaguuuauucggatt

SEQ ID NO: 946 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
uccgaauaaacuccaggcctt

SEQ ID NO: 947 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ggccuggaguuuauucggatt

SEQ ID NO: 948 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
uccgaauaaacuccaggcctt

SEQ ID NO: 949 - DNA, 21 bp, Artificial sequence
  siRNAs to PCSK9
  modified_base 1..19: /mod_base = "2'-hydroxy corresponding base"
gcaggauucuucccauggatt

SEQ ID NO: 950 - DNA, 21 bp, Artificial sequence
  siRNAs to PCSK9
  modified_base 1..19: /mod_base = "2'-hydroxy corresponding base"
uccaugggaagaauccugctt

SEQ ID NO: 951 - DNA, 21 bp, Artificial sequence
  siRNAs to PCSK9
  modified_base 1..19: /mod_base = "2'-hydroxy corresponding base"
ugcagggacaaacaucguutt

SEQ ID NO: 952 - DNA, 21 bp, Artificial sequence
  siRNAs to PCSK9
  modified_base 1..19: /mod_base = "2'-hydroxy corresponding base"
aacgauguuugucccugcatt

SEQ ID NO: 953 - DNA, 21 bp, Artificial sequence
  siRNAs to PCSK9
  modified_base 1..19: /mod_base = "2'-hydroxy corresponding base"
gcagggacaaacaucguugtt

SEQ ID NO: 954 - DNA, 21 bp, Artificial sequence
  siRNAs to PCSK9
  modified_base 1..19: /mod_base = "2'-hydroxy corresponding base"
caacgauguuugucccugctt

SEQ ID NO: 955 - DNA, 21 bp, Artificial sequence
  siRNAs to PCSK9
  modified_base 1..19: /mod_base = "2'-hydroxy corresponding base"
agggacaaacaucguugggtt

SEQ ID NO: 956 - DNA, 21 bp, Artificial sequence
  siRNAs to PCSK9
  modified_base 1..19: /mod_base = "2'-hydroxy corresponding base"
cccaacgauguuugucccutt

SEQ ID NO: 957 - DNA, 21 bp, Artificial sequence
  siRNAs to PCSK9
  modified_base 1..19: /mod_base = "2'-hydroxy corresponding base"
cccucaucuccagcuaacutt

SEQ ID NO: 958 - DNA, 21 bp, Artificial sequence
  siRNAs to PCSK9
  modified_base 1..19: /mod_base = "2'-hydroxy corresponding base"
aguuagcuggagaugagggtt

SEQ ID NO: 959 - DNA, 21 bp, Artificial sequence
  siRNAs to PCSK9
  modified_base 1..19: /mod_base = "2'-hydroxy corresponding base"
caucuccagcuaacuguggtt

SEQ ID NO: 960 - DNA, 21 bp, Artificial sequence
  siRNAs to PCSK9
  modified_base 1..19: /mod_base = "2'-hydroxy corresponding base"
ccacaguuagcuggagaugtt

SEQ ID NO: 961 - DNA, 21 bp, Artificial sequence
  siRNAs to PCSK9
  modified_base 1..19: /mod_base = "2'-hydroxy corresponding base"
gcucccugauuaauggaggtt

SEQ ID NO: 962 - DNA, 21 bp, Artificial sequence
  siRNAs to PCSK9
  modified_base 1..19: /mod_base = "2'-hydroxy corresponding base"
ccuccauuaaucagggagctt

SEQ ID NO: 963 - DNA, 21 bp, Artificial sequence
  siRNAs to PCSK9
  modified_base 1..19: /mod_base = "2'-hydroxy corresponding base"
cccugauuaauggaggcuutt

SEQ ID NO: 964 - DNA, 21 bp, Artificial sequence
  siRNAs to PCSK9
  modified_base 1..19: /mod_base = "2'-hydroxy corresponding base"
aagccuccauuaaucagggtt

SEQ ID NO: 965 - DNA, 21 bp, Artificial sequence
  siRNAs to PCSK9
  modified_base 1..19: /mod_base = "2'-hydroxy corresponding base"
ccugauuaauggaggcuuatt

SEQ ID NO: 966 - DNA, 21 bp, Artificial sequence
  siRNAs to PCSK9
  modified_base 1..19: /mod_base = "2'-hydroxy corresponding base"
uaagccuccauuaaucaggtt

SEQ ID NO: 967 - DNA, 21 bp, Artificial sequence
  siRNAs to PCSK9
  modified_base 1..19: /mod_base = "2'-hydroxy corresponding base"
ugauuaauggaggcuuagctt

SEQ ID NO: 968 - DNA, 21 bp, Artificial sequence
  siRNAs to PCSK9
  modified_base 1..19: /mod_base = "2'-hydroxy corresponding base"
gcuaagccuccauuaaucatt

SEQ ID NO: 969 - DNA, 21 bp, Artificial sequence
  siRNAs to PCSK9
  modified_base 1..19: /mod_base = "2'-hydroxy corresponding base"
gauuaauggaggcuuagcutt

SEQ ID NO: 970 - DNA, 21 bp, Artificial sequence
  siRNAs to PCSK9
  modified_base 1..19: /mod_base = "2'-hydroxy corresponding base"
agcuaagccuccauuaauctt

SEQ ID NO: 971 - DNA, 21 bp, Artificial sequence
  siRNAs to PCSK9
  modified_base 1..19: /mod_base = "2'-hydroxy corresponding base"
auuaauggaggcuuagcuutt

SEQ ID NO: 972 - DNA, 21 bp, Artificial sequence
  siRNAs to PCSK9
  modified_base 1..19: /mod_base = "2'-hydroxy corresponding base"
aagcuaagccuccauuaautt

SEQ ID NO: 973 - DNA, 21 bp, Artificial sequence
  siRNAs to PCSK9
  modified_base 1..19: /mod_base = "2'-hydroxy corresponding base"
uuaauggaggcuuagcuuutt

SEQ ID NO: 974 - DNA, 21 bp, Artificial sequence
  siRNAs to PCSK9
  modified_base 1..19: /mod_base = "2'-hydroxy corresponding base"
aaagcuaagccuccauuaatt

SEQ ID NO: 975 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uuucuggauggcaucuagctt

SEQ ID NO: 976 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gcuagaugccauccagaaatt

SEQ ID NO: 977 - DNA, 21 bp, Artificial sequence
  siRNAs to PCSK9
  modified_base 1, 2, 3, 4, 5, 9, 12, 14, 15, 16, 19: /mod_base = "2'-O-methyl corresponding base"
  modified_base 21: /mod_base = "5'-thio thymidine"
  modified_base 6, 7, 8, 10, 11, 13, 17, 18: /mod_base = "2'-hydroxy corresponding base"
uuucuggauggcaucuagctt

SEQ ID NO: 978 - DNA, 21 bp, Artificial sequence
  siRNAs to PCSK9
  modified_base 3, 10, 14: /mod_base = "2'-O-methyl corresponding base"
  modified_base 21: /mod_base = "5'-thio thymidine"
  modified_base 1, 2, 4, 5, 6, 7, 8, 9, 11, 12, 13, 15, 16, 17, 18, 19: /mod_base = "2'-hydroxy corresponding base"
gcuagaugccauccagaaatt

SEQ ID NO: 979 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uucuggauggcaucuagcctt

SEQ ID NO: 980 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ggcuagaugccauccagaatt

SEQ ID NO: 981 - DNA, 21 bp, Artificial sequence
  siRNAs to PCSK9
  modified_base 1, 2, 3, 4, 8, 11, 13, 14, 15, 18, 19: /mod_base = "2'-O-methyl corresponding base"
  modified_base 21: /mod_base = "5'-thio thymidine"
  modified_base 5, 6, 7, 9, 10, 12, 16, 17: /mod_base = "2'-hydroxy corresponding base"
uucuggauggcaucuagcctt

SEQ ID NO: 982 - DNA, 21 bp, Artificial sequence
  siRNAs to PCSK9
  modified_base 4, 11, 15: /mod_base = "2'-O-methyl corresponding base"
  modified_base 21: /mod_base = "5'-thio thymidine"
  modified_base 1, 2, 3, 5, 6, 7, 8, 9, 10, 12, 13, 14, 16, 17, 18, 19: /mod_base = "2'-hydroxy corresponding base"
ggcuagaugccauccagaatt

SEQ ID NO: 983 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ucuggauggcaucuagccatt

SEQ ID NO: 984 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uggcuagaugccauccagatt

SEQ ID NO: 985 - DNA, 21 bp, Artificial sequence
  siRNAs to PCSK9
  modified_base 1, 2, 3, 7, 10, 12, 13, 14, 17, 18: /mod_base = "2'-O-methyl corresponding base"
  modified_base 21: /mod_base = "5'-thio thymidine"
  modified_base 4, 5, 6, 8, 9, 11, 15, 16, 19: /mod_base = "2'-hydroxy corresponding base"
ucuggauggcaucuagccatt

SEQ ID NO: 986 - DNA, 21 bp, Artificial sequence
  siRNAs to PCSK9
  modified_base 5, 12, 16: /mod_base = "2'-O-methyl corresponding base"
  modified_base 21: /mod_base = "5'-thio thymidine"
  modified_base 1, 2, 3, 4, 6, 7, 8, 9, 10, 11, 13, 14, 15, 17, 18, 19: /mod_base = "2'-hydroxy corresponding base"
uggcuagaugccauccagatt

SEQ ID NO: 987 - DNA, 21 bp, Artificial sequence
  siRNAs to PCSK9
  modified_base 1..19: /mod_base = "2'-hydroxy corresponding base"
aggcuggagacaggugcgctt

SEQ ID NO: 988 - DNA, 21 bp, Artificial sequence
  siRNAs to PCSK9
  modified_base 1..19: /mod_base = "2'-hydroxy corresponding base"
gcgcaccugucuccagccutt

SEQ ID NO: 989 - DNA, 21 bp, Artificial sequence
  siRNAs to PCSK9
  modified_base 1..19: /mod_base = "2'-hydroxy corresponding base"
ggcuggagacaggugcgcctt

SEQ ID NO: 990 - DNA, 21 bp, Artificial sequence
  siRNAs to PCSK9
  modified_base 1..19: /mod_base = "2'-hydroxy corresponding base"
ggcgcaccugucuccagcctt

SEQ ID NO: 991 - DNA, 21 bp, Artificial sequence
  siRNAs to PCSK9
  modified_base 1..19: /mod_base = "2'-hydroxy corresponding base"
gcuggagacaggugcgccctt

SEQ ID NO: 992 - DNA, 21 bp, Artificial sequence
  siRNAs to PCSK9
  modified_base 1..19: /mod_base = "2'-hydroxy corresponding base"
gggcgcaccugucuccagctt

SEQ ID NO: 993 - DNA, 21 bp, Artificial sequence
  siRNAs to PCSK9
  modified_base 1..19: /mod_base = "2'-hydroxy corresponding base"
uuccugagccaccuuuacutt

SEQ ID NO: 994 - DNA, 21 bp, Artificial sequence
  siRNAs to PCSK9
  modified_base 1..19: /mod_base = "2'-hydroxy corresponding base"
aguaaagguggcucaggaatt

SEQ ID NO: 995 - DNA, 21 bp, Artificial sequence
  siRNAs to PCSK9
  modified_base 1..19: /mod_base = "2'-hydroxy corresponding base"
uccugagccaccuuuacuctt

SEQ ID NO: 996 - DNA, 21 bp, Artificial sequence
  siRNAs to PCSK9
  modified_base 1..19: /mod_base = "2'-hydroxy corresponding base"
gaguaaagguggcucaggatt

SEQ ID NO: 997 - DNA, 21 bp, Artificial sequence
  siRNAs to PCSK9
  modified_base 1..19: /mod_base = "2'-hydroxy corresponding base"
ccugagccaccuuuacucutt

SEQ ID NO: 998 - DNA, 21 bp, Artificial sequence
  siRNAs to PCSK9
  modified_base 1..19: /mod_base = "2'-hydroxy corresponding base"
agaguaaagguggcucaggtt

SEQ ID NO: 999 - DNA, 21 bp, Artificial sequence
  siRNAs to PCSK9
  modified_base 1..19: /mod_base = "2'-hydroxy corresponding base"
ugagccaccuuuacucugctt

SEQ ID NO: 1000 - DNA, 21 bp, Artificial sequence
  siRNAs to PCSK9
  modified_base 1..19: /mod_base = "2'-hydroxy corresponding base"
gcagaguaaagguggcucatt

SEQ ID NO: 1001 - DNA, 21 bp, Artificial sequence
  siRNAs to PCSK9
  modified_base 1..19: /mod_base = "2'-hydroxy corresponding base"
agccaccuuuacucugcuctt

SEQ ID NO: 1002 - DNA, 21 bp, Artificial sequence
  siRNAs to PCSK9
  modified_base 1..19: /mod_base = "2'-hydroxy corresponding base"
gagcagaguaaagguggcutt

SEQ ID NO: 1003 - DNA, 21 bp, Artificial sequence
  siRNAs to PCSK9
  modified_base 1..19: /mod_base = "2'-hydroxy corresponding base"
caccuuuacucugcucuautt

SEQ ID NO: 1004 - DNA, 21 bp, Artificial sequence
  siRNAs to PCSK9
  modified_base 1..19: /mod_base = "2'-hydroxy corresponding base"
auagagcagaguaaaggugtt

SEQ ID NO: 1005 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uacucugcucuaugccaggtt

SEQ ID NO: 1006 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ccuggcauagagcagaguatt

SEQ ID NO: 1007 - DNA, 21 bp, Artificial sequence
  siRNAs to PCSK9
  modified_base 1, 3, 4, 5, 6, 8, 9, 10, 11, 13, 15, 16: /mod_base = "2'-O-methyl corresponding base"
  modified_base 21: /mod_base = "5'-thio thymidine"
  modified_base 2, 7, 12, 14, 17, 18, 19: /mod_base = "2'-hydroxy corresponding base"
uacucugcucuaugccaggtt

SEQ ID NO: 1008 - DNA, 21 bp, Artificial sequence
  siRNAs to PCSK9
  modified_base 6, 8, 13, 18: /mod_base = "2'-O-methyl corresponding base"
  modified_base 21: /mod_base = "5'-thio thymidine"
  modified_base 1, 2, 3, 4, 5, 7, 9, 10, 11, 12, 14, 15, 16, 17, 19: /mod_base = "2'-hydroxy corresponding base"
ccuggcauagagcagaguatt

SEQ ID NO: 1009 - DNA, 21 bp, Artificial sequence
  siRNAs to PCSK9
  modified_base 1..19: /mod_base = "2'-hydroxy corresponding base"
augccaggcugugcuagcatt

SEQ ID NO: 1010 - DNA, 21 bp, Artificial sequence
  siRNAs to PCSK9
  modified_base 1..19: /mod_base = "2'-hydroxy corresponding base"
ugcuagcacagccuggcautt

SEQ ID NO: 1011 - DNA, 21 bp, Artificial sequence
  siRNAs to PCSK9
  modified_base 1..19: /mod_base = "2'-hydroxy corresponding base"
aggcugugcuagcaacacctt

SEQ ID NO: 1012 - DNA, 21 bp, Artificial sequence
  siRNAs to PCSK9
  modified_base 1..19: /mod_base = "2'-hydroxy corresponding base"
gguguugcuagcacagccutt

SEQ ID NO: 1013 - DNA, 21 bp, Artificial sequence
  siRNAs to PCSK9
  modified_base 1..19: /mod_base = "2'-hydroxy corresponding base"
cugugcuagcaacacccaatt

SEQ ID NO: 1014 - DNA, 21 bp, Artificial sequence
  siRNAs to PCSK9
  modified_base 1..19: /mod_base = "2'-hydroxy corresponding base"
uuggguguugcuagcacagtt

SEQ ID NO: 1015 - DNA, 21 bp, Artificial sequence
  siRNAs to PCSK9
  modified_base 1..19: /mod_base = "2'-hydroxy corresponding base"
gcuagcaacacccaaaggutt

SEQ ID NO: 1016 - DNA, 21 bp, Artificial sequence
  siRNAs to PCSK9
  modified_base 1..19: /mod_base = "2'-hydroxy corresponding base"
accuuuggguguugcuagctt

SEQ ID NO: 1017 - DNA, 21 bp, Artificial sequence
  siRNAs to PCSK9
  modified_base 1..19: /mod_base = "2'-hydroxy corresponding base"
ggagccaucaccuaggacutt

SEQ ID NO: 1018 - DNA, 21 bp, Artificial sequence
  siRNAs to PCSK9
  modified_base 1..19: /mod_base = "2'-hydroxy corresponding base"
aguccuaggugauggcucctt

SEQ ID NO: 1019 - DNA, 21 bp, Artificial sequence
  siRNAs to PCSK9
  modified_base 1..19: /mod_base = "2'-hydroxy corresponding base"
caccuaggacugacucggctt

SEQ ID NO: 1020 - DNA, 21 bp, Artificial sequence
  siRNAs to PCSK9
  modified_base 1..19: /mod_base = "2'-hydroxy corresponding base"
gccgagucaguccuaggugtt

SEQ ID NO: 1021 - DNA, 21 bp, Artificial sequence
  siRNAs to PCSK9
  modified_base 1..19: /mod_base = "2'-hydroxy corresponding base"
aggacugacucggcagugutt

SEQ ID NO: 1022 - DNA, 21 bp, Artificial sequence
  siRNAs to PCSK9
  modified_base 1..19: /mod_base = "2'-hydroxy corresponding base"
acacugccgagucaguccutt

SEQ ID NO: 1023 - DNA, 21 bp, Artificial sequence
  siRNAs to PCSK9
  modified_base 1..19: /mod_base = "2'-hydroxy corresponding base"
ggacugacucggcagugugtt

SEQ ID NO: 1024 - DNA, 21 bp, Artificial sequence
  siRNAs to PCSK9
  modified_base 1..19: /mod_base = "2'-hydroxy corresponding base"
cacacugccgagucagucctt

SEQ ID NO: 1025 - DNA, 21 bp, Artificial sequence
  siRNAs to PCSK9
  modified_base 1..19: /mod_base = "2'-hydroxy corresponding base"
uggugcaugcacugucucatt

SEQ ID NO: 1026 - DNA, 21 bp, Artificial sequence
  siRNAs to PCSK9
  modified_base 1..19: /mod_base = "2'-hydroxy corresponding base"
ugagacagugcaugcaccatt

SEQ ID NO: 1027 - DNA, 21 bp, Artificial sequence
  siRNAs to PCSK9
  modified_base 1..19: /mod_base = "2'-hydroxy corresponding base"
augcacugucucagccaactt

SEQ ID NO: 1028 - DNA, 21 bp, Artificial sequence
  siRNAs to PCSK9
  modified_base 1..19: /mod_base = "2'-hydroxy corresponding base"
guuggcugagacagugcautt

SEQ ID NO: 1029 - DNA, 21 bp, Artificial sequence
  siRNAs to PCSK9
  modified_base 1..19: /mod_base = "2'-hydroxy corresponding base"
cugucucagccaacccgcutt

SEQ ID NO: 1030 - DNA, 21 bp, Artificial sequence
  siRNAs to PCSK9
  modified_base 1..19: /mod_base = "2'-hydroxy corresponding base"
agcggguuggcugagacagtt

SEQ ID NO: 1031 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cucagccaacccgcuccactt

SEQ ID NO: 1032 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
guggagcggguuggcugagtt

SEQ ID NO: 1033 - DNA, 21 bp, Artificial sequence
  siRNAs to PCSK9
  modified_base 1, 2, 3, 6, 7, 10, 11, 12, 14, 15, 16, 17, 19: /mod_base = "2'-O-methyl corresponding base"
  modified_base 21: /mod_base = "5'-thio thymidine"
  modified_base 4, 5, 8, 9, 13, 18: /mod_base = "2'-hydroxy corresponding base"
cucagccaacccgcuccactt

SEQ ID NO: 1034 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
guggagcggguuggcugagtt

SEQ ID NO: 1035 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gccaacccgcuccacuacctt

SEQ ID NO: 1036 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gguaguggagcggguuggctt

SEQ ID NO: 1037 - DNA, 21 bp, Artificial sequence
  siRNAs to PCSK9
  modified_base 2, 3, 6, 7, 8, 10, 11, 12, 13, 15, 16, 18, 19: /mod_base = "2'-O-methyl corresponding base"
  modified_base 21: /mod_base = "5'-thio thymidine"
  modified_base 1, 4, 5, 9, 14, 17: /mod_base = "2'-hydroxy corresponding base"
gccaacccgcuccacuacctt

SEQ ID NO: 1038 - DNA, 21 bp, Artificial sequence
  siRNAs to PCSK9
  modified_base 3: /mod_base = "2'-O-methyl corresponding base"
  modified_base 21: /mod_base = "5'-thio thymidine"
  modified_base 1, 2, 4, 5, 6, 7, 8, 9, 10, 11, 12, 13, 14, 15, 16, 17, 18, 19: /mod_base = "2'-hydroxy corresponding base"
gguaguggagcggguuggctt

SEQ ID NO: 1039 - DNA, 21 bp, Artificial sequence
  siRNAs to PCSK9
  modified_base 1..19: /mod_base = "2'-hydroxy corresponding base"
aacccgcuccacuacccggtt

SEQ ID NO: 1040 - DNA, 21 bp, Artificial sequence
  siRNAs to PCSK9
  modified_base 1..19: /mod_base = "2'-hydroxy corresponding base"
ccggguaguggagcggguutt

SEQ ID NO: 1041 - DNA, 21 bp, Artificial sequence
  siRNAs to PCSK9
  modified_base 1..19: /mod_base = "2'-hydroxy corresponding base"
ccgcuccacuacccggcagtt

SEQ ID NO: 1042 - DNA, 21 bp, Artificial sequence
  siRNAs to PCSK9
  modified_base 1..19: /mod_base = "2'-hydroxy corresponding base"
cugccggguaguggagcggtt

SEQ ID NO: 1043 - DNA, 21 bp, Artificial sequence
  siRNAs to PCSK9
  modified_base 1..19: /mod_base = "2'-hydroxy corresponding base"
cuacccggcaggguacacatt

SEQ ID NO: 1044 - DNA, 21 bp, Artificial sequence
  siRNAs to PCSK9
  modified_base 1..19: /mod_base = "2'-hydroxy corresponding base"
uguguacccugccggguagtt

SEQ ID NO: 1045 - DNA, 21 bp, Artificial sequence
  siRNAs to PCSK9
  modified_base 1..19: /mod_base = "2'-hydroxy corresponding base"
uacccggcaggguacacautt

SEQ ID NO: 1046 - DNA, 21 bp, Artificial sequence
  siRNAs to PCSK9
  modified_base 1..19: /mod_base = "2'-hydroxy corresponding base"
auguguacccugccggguatt

SEQ ID NO: 1047 - DNA, 21 bp, Artificial sequence
  siRNAs to PCSK9
  modified_base 1..19: /mod_base = "2'-hydroxy corresponding base"
acccggcaggguacacauutt

SEQ ID NO: 1048 - DNA, 21 bp, Artificial sequence
  siRNAs to PCSK9
  modified_base 1..19: /mod_base = "2'-hydroxy corresponding base"
aauguguacccugccgggutt

SEQ ID NO: 1049 - DNA, 21 bp, Artificial sequence
  siRNAs to PCSK9
  modified_base 1..19: /mod_base = "2'-hydroxy corresponding base"
cccggcaggguacacauuctt

SEQ ID NO: 1050 - DNA, 21 bp, Artificial sequence
  siRNAs to PCSK9
  modified_base 1..19: /mod_base = "2'-hydroxy corresponding base"
gaauguguacccugccgggtt

SEQ ID NO: 1051 - DNA, 21 bp, Artificial sequence
  siRNAs to PCSK9
  modified_base 1..19: /mod_base = "2'-hydroxy corresponding base"
cggcaggguacacauucgctt

SEQ ID NO: 1052 - DNA, 21 bp, Artificial sequence
  siRNAs to PCSK9
  modified_base 1..19: /mod_base = "2'-hydroxy corresponding base"
gcgaauguguacccugccgtt

SEQ ID NO: 1053 - DNA, 21 bp, Artificial sequence
  siRNAs to PCSK9
  modified_base 1..19: /mod_base = "2'-hydroxy corresponding base"
gcaggguacacauucgcactt

SEQ ID NO: 1054 - DNA, 21 bp, Artificial sequence
  siRNAs to PCSK9
  modified_base 1..19: /mod_base = "2'-hydroxy corresponding base"
gugcgaauguguacccugctt

SEQ ID NO: 1055 - DNA, 21 bp, Artificial sequence
  siRNAs to PCSK9
  modified_base 1..19: /mod_base = "2'-hydroxy corresponding base"
caggguacacauucgcacctt

SEQ ID NO: 1056 - DNA, 21 bp, Artificial sequence
  siRNAs to PCSK9
  modified_base 1..19: /mod_base = "2'-hydroxy corresponding base"
ggugcgaauguguacccugtt

SEQ ID NO: 1057 - DNA, 21 bp, Artificial sequence
  siRNAs to PCSK9
  modified_base 1..19: /mod_base = "2'-hydroxy corresponding base"
aggguacacauucgcaccctt

SEQ ID NO: 1058 - DNA, 21 bp, Artificial sequence
  siRNAs to PCSK9
  modified_base 1..19: /mod_base = "2'-hydroxy corresponding base"
gggugcgaauguguacccutt

SEQ ID NO: 1059 - DNA, 21 bp, Artificial sequence
  siRNAs to PCSK9
  modified_base 1..19: /mod_base = "2'-hydroxy corresponding base"
ggaacugagccagaaacgctt

SEQ ID NO: 1060 - DNA, 21 bp, Artificial sequence
  siRNAs to PCSK9
  modified_base 1..19: /mod_base = "2'-hydroxy corresponding base"
gcguuucuggcucaguucctt

SEQ ID NO: 1061 - DNA, 21 bp, Artificial sequence
  siRNAs to PCSK9
  modified_base 1..19: /mod_base = "2'-hydroxy corresponding base"
gaacugagccagaaacgcatt

SEQ ID NO: 1062 - DNA, 21 bp, Artificial sequence
  siRNAs to PCSK9
  modified_base 1..19: /mod_base = "2'-hydroxy corresponding base"
ugcguuucuggcucaguuctt

SEQ ID NO: 1063 - DNA, 21 bp, Artificial sequence
  siRNAs to PCSK9
  modified_base 1..19: /mod_base = "2'-hydroxy corresponding base"
aacugagccagaaacgcagtt

SEQ ID NO: 1064 - DNA, 21 bp, Artificial sequence
  siRNAs to PCSK9
  modified_base 1..19: /mod_base = "2'-hydroxy corresponding base"
cugcguuucuggcucaguutt

SEQ ID NO: 1065 - DNA, 21 bp, Artificial sequence
  siRNAs to PCSK9
  modified_base 1..19: /mod_base = "2'-hydroxy corresponding base"
ugagccagaaacgcagauutt

SEQ ID NO: 1066 - DNA, 21 bp, Artificial sequence
  siRNAs to PCSK9
  modified_base 1..19: /mod_base = "2'-hydroxy corresponding base"
aaucugcguuucuggcucatt

SEQ ID NO: 1067 - DNA, 21 bp, Artificial sequence
  siRNAs to PCSK9
  modified_base 1..19: /mod_base = "2'-hydroxy corresponding base"
agaaacgcagauugggcugtt

SEQ ID NO: 1068 - DNA, 21 bp, Artificial sequence
  siRNAs to PCSK9
  modified_base 1..19: /mod_base = "2'-hydroxy corresponding base"
cagcccaaucugcguuucutt

SEQ ID NO: 1069 - DNA, 21 bp, Artificial sequence
  siRNAs to PCSK9
  modified_base 1..19: /mod_base = "2'-hydroxy corresponding base"
aacgcagauugggcuggcutt

SEQ ID NO: 1070 - DNA, 21 bp, Artificial sequence
  siRNAs to PCSK9
  modified_base 1..19: /mod_base = "2'-hydroxy corresponding base"
agccagcccaaucugcguutt

SEQ ID NO: 1071 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
agccaagccucuucuuacutt

SEQ ID NO: 1072 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
aguaagaagaggcuuggcutt

SEQ ID NO: 1073 - DNA, 21 bp, Artificial sequence
  siRNAs to PCSK9
  modified_base 3, 4, 8, 9, 10, 11, 12, 13, 14, 15, 16, 18, 19: /mod_base = "2'-O-methyl corresponding base"
  modified_base 21: /mod_base = "5'-thio thymidine"
  modified_base 1, 2, 5, 6, 7, 17: /mod_base = "2'-hydroxy corresponding base"
agccaagccucuucuuacutt

SEQ ID NO: 1074 - DNA, 21 bp, Artificial sequence
  siRNAs to PCSK9
  modified_base 3: /mod_base = "2'-O-methyl corresponding base"
  modified_base 21: /mod_base = "5'-thio thymidine"
  modified_base 1, 2, 4, 5, 6, 7, 8, 9, 10, 11, 12, 13, 14, 15, 16, 17, 18, 19: /mod_base = "2'-hydroxy corresponding base"
aguaagaagaggcuuggcutt

SEQ ID NO: 1075 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
agccaagccucuucuuacutt

SEQ ID NO: 1076 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
aguaagaagaggcuuggcutt

SEQ ID NO: 1077 - DNA, 21 bp, Artificial sequence
  siRNAs to PCSK9
  modified_base 3, 4, 8, 9, 10, 11, 12, 13, 14, 15, 16, 18, 19: /mod_base = "2'-deoxy-2'-fluoro corresponding base"
  modified_base 21: /mod_base = "5'-thio thymidine"
  modified_base 1, 2, 5, 6, 7, 17: /mod_base = "2'-hydroxy corresponding base"
agccaagccucuucuuacutt

SEQ ID NO: 1078 - DNA, 21 bp, Artificial sequence
  siRNAs to PCSK9
  modified_base 3, 13, 14, 15, 18, 19: /mod_base = "2'-deoxy-2'-fluoro corresponding base"
  modified_base 21: /mod_base = "5'-thio thymidine"
  modified_base 1, 2, 4, 5, 6, 7, 8, 9, 10, 11, 12, 16, 17: /mod_base = "2'-hydroxy corresponding base"
aguaagaagaggcuuggcutt

SEQ ID NO: 1079 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
agccaagccucuucuuacutt

SEQ ID NO: 1080 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
aguaagaagaggcuuggcutt

SEQ ID NO: 1081 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
agccaagccucuucuuacutt

SEQ ID NO: 1082 - DNA, 21 bp, Artificial sequence
  siRNAs to PCSK9
  modified_base 3, 13, 14, 15, 18, 19: /mod_base = "2'-deoxy-2'-fluoro corresponding base"
  modified_base 21: /mod_base = "5'-thio thymidine"
  modified_base 1, 2, 4, 5, 6, 7, 8, 9, 10, 11, 12, 16, 17: /mod_base = "2'-hydroxy corresponding base"
aguaagaagaggcuuggcutt

SEQ ID NO: 1083 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
agccaagccucuucuuacutt

SEQ ID NO: 1084 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
aguaagaagaggcuuggcutt

SEQ ID NO: 1085 - DNA, 21 bp, Artificial sequence
  siRNAs to PCSK9
  modified_base 3, 4, 8, 9, 10, 11, 12, 13, 14, 15, 16, 18, 19: /mod_base = "2'-deoxy-2'-fluoro corresponding base"
  modified_base 21: /mod_base = "5'-thio thymidine"
  modified_base 1, 2, 5, 6, 7, 17: /mod_base = "2'-hydroxy corresponding base"
agccaagccucuucuuacutt

SEQ ID NO: 1086 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
aguaagaagaggcuuggcutt

SEQ ID NO: 1087 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
agccaagccucuucuuacutt

SEQ ID NO: 1088 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
aguaagaagaggcuuggcutt

SEQ ID NO: 1089 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
ugguucccugaggaccagctt

SEQ ID NO: 1090 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
gcugguccucagggaaccatt

SEQ ID NO: 1091 - DNA, 21 bp, Artificial sequence
  siRNAs to PCSK9
  modified_base 1, 4, 5, 6, 7, 8, 9, 15, 16, 19: /mod_base = "2'-deoxy-2'-fluoro corresponding base"
  modified_base 21: /mod_base = "5'-thio thymidine"
  modified_base 2, 3, 10, 11, 12, 13, 14, 17, 18: /mod_base = "2'-hydroxy corresponding base"
ugguucccugaggaccagctt

SEQ ID NO: 1092 - DNA, 21 bp, Artificial sequence
  siRNAs to PCSK9
  modified_base 2, 3, 6, 7, 8, 9, 10, 17, 18: /mod_base = "2'-deoxy-2'-fluoro corresponding base"
  modified_base 21: /mod_base = "5'-thio thymidine"
  modified_base 1, 4, 5, 11, 12, 13, 14, 15, 16, 19: /mod_base = "2'-hydroxy corresponding base"
gcugguccucagggaaccatt

SEQ ID NO: 1093 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ugguucccugaggaccagctt

SEQ ID NO: 1094 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
gcugguccucagggaaccatt

SEQ ID NO: 1095 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ugguucccugaggaccagctt

SEQ ID NO: 1096 - DNA, 21 bp, Artificial sequence
  siRNAs to PCSK9
  modified_base 2, 3, 6, 7, 8, 9, 10, 17, 18: /mod_base = "2'-deoxy-2'-fluoro corresponding base"
  modified_base 21: /mod_base = "5'-thio thymidine"
  modified_base 1, 4, 5, 11, 12, 13, 14, 15, 16, 19: /mod_base = "2'-hydroxy corresponding base"
gcugguccucagggaaccatt

SEQ ID NO: 1097 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
ugguucccugaggaccagctt

SEQ ID NO: 1098 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
gcugguccucagggaaccatt

SEQ ID NO: 1099 - DNA, 21 bp, Artificial sequence
  siRNAs to PCSK9
  modified_base 1, 4, 5, 6, 7, 8, 9, 15, 16, 19: /mod_base = "2'-deoxy-2'-fluoro corresponding base"
  modified_base 21: /mod_base = "5'-thio thymidine"
  modified_base 2, 3, 10, 11, 12, 13, 14, 17, 18: /mod_base = "2'-hydroxy corresponding base"
ugguucccugaggaccagctt

SEQ ID NO: 1100 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
gcugguccucagggaaccatt

SEQ ID NO: 1101 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ugguucccugaggaccagctt

SEQ ID NO: 1102 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
gcugguccucagggaaccatt

SEQ ID NO: 1103 - DNA, 21 bp, Artificial sequence
  siRNAs to PCSK9
  modified_base 1..19: /mod_base = "2'-hydroxy corresponding base"
ucuucuuacuucacccggctt

SEQ ID NO: 1104 - DNA, 21 bp, Artificial sequence
  siRNAs to PCSK9
  modified_base 1..19: /mod_base = "2'-hydroxy corresponding base"
gccgggugaaguaagaagatt

SEQ ID NO: 1105 - DNA, 21 bp, Artificial sequence
  siRNAs to PCSK9
  modified_base 1..19: /mod_base = "2'-hydroxy corresponding base"
cuucuuacuucacccggcutt

SEQ ID NO: 1106 - DNA, 21 bp, Artificial sequence
  siRNAs to PCSK9
  modified_base 1..19: /mod_base = "2'-hydroxy corresponding base"
agccgggugaaguaagaagtt

SEQ ID NO: 1107 - DNA, 21 bp, Artificial sequence
  siRNAs to PCSK9
  modified_base 1..19: /mod_base = "2'-hydroxy corresponding base"
uucuuacuucacccggcugtt

SEQ ID NO: 1108 - DNA, 21 bp, Artificial sequence
  siRNAs to PCSK9
  modified_base 1..19: /mod_base = "2'-hydroxy corresponding base"
cagccgggugaaguaagaatt

SEQ ID NO: 1109 - DNA, 21 bp, Artificial sequence
  siRNAs to PCSK9
  modified_base 1..19: /mod_base = "2'-hydroxy corresponding base"
gggcuccucauuuuuacggtt

SEQ ID NO: 1110 - DNA, 21 bp, Artificial sequence
  siRNAs to PCSK9
  modified_base 1..19: /mod_base = "2'-hydroxy corresponding base"
ccguaaaaaugaggagccctt

SEQ ID NO: 1111 - DNA, 21 bp, Artificial sequence
  siRNAs to PCSK9
  modified_base 1..19: /mod_base = "2'-hydroxy corresponding base"
ggcuccucauuuuuacgggtt

SEQ ID NO: 1112 - DNA, 21 bp, Artificial sequence
  siRNAs to PCSK9
  modified_base 1..19: /mod_base = "2'-hydroxy corresponding base"
cccguaaaaaugaggagcctt

SEQ ID NO: 1113 - DNA, 21 bp, Artificial sequence
  siRNAs to PCSK9
  modified_base 1..19: /mod_base = "2'-hydroxy corresponding base"
gcuccucauuuuuacgggutt

SEQ ID NO: 1114 - DNA, 21 bp, Artificial sequence
  siRNAs to PCSK9
  modified_base 1..19: /mod_base = "2'-hydroxy corresponding base"
acccguaaaaaugaggagctt

SEQ ID NO: 1115 - DNA, 21 bp, Artificial sequence
  siRNAs to PCSK9
  modified_base 1..19: /mod_base = "2'-hydroxy corresponding base"
cuccucauuuuuacggguatt

SEQ ID NO: 1116 - DNA, 21 bp, Artificial sequence
  siRNAs to PCSK9
  modified_base 1..19: /mod_base = "2'-hydroxy corresponding base"
uacccguaaaaaugaggagtt

SEQ ID NO: 1117 - DNA, 21 bp, Artificial sequence
  siRNAs to PCSK9
  modified_base 1..19: /mod_base = "2'-hydroxy corresponding base"
uccucauuuuuacggguaatt

SEQ ID NO: 1118 - DNA, 21 bp, Artificial sequence
  siRNAs to PCSK9
  modified_base 1..19: /mod_base = "2'-hydroxy corresponding base"
uuacccguaaaaaugaggatt

SEQ ID NO: 1119 - DNA, 21 bp, Artificial sequence
  siRNAs to PCSK9
  modified_base 1..19: /mod_base = "2'-hydroxy corresponding base"
ccucauuuuuacggguaactt

SEQ ID NO: 1120 - DNA, 21 bp, Artificial sequence
  siRNAs to PCSK9
  modified_base 1..19: /mod_base = "2'-hydroxy corresponding base"
guuacccguaaaaaugaggtt

SEQ ID NO: 1121 - DNA, 21 bp, Artificial sequence
  siRNAs to PCSK9
  modified_base 1..19: /mod_base = "2'-hydroxy corresponding base"
cucauuuuuacggguaacatt

SEQ ID NO: 1122 - DNA, 21 bp, Artificial sequence
  siRNAs to PCSK9
  modified_base 1..19: /mod_base = "2'-hydroxy corresponding base"
uguuacccguaaaaaugagtt

SEQ ID NO: 1123 - DNA, 21 bp, Artificial sequence
  siRNAs to PCSK9
  modified_base 1..19: /mod_base = "2'-hydroxy corresponding base"
cauuuuuacggguaacagutt

SEQ ID NO: 1124 - DNA, 21 bp, Artificial sequence
  siRNAs to PCSK9
  modified_base 1..19: /mod_base = "2'-hydroxy corresponding base"
acuguuacccguaaaaaugtt

SEQ ID NO: 1125 - DNA, 21 bp, Artificial sequence
  siRNAs to PCSK9
  modified_base 1..19: /mod_base = "2'-hydroxy corresponding base"
auuuuuacggguaacagugtt

SEQ ID NO: 1126 - DNA, 21 bp, Artificial sequence
  siRNAs to PCSK9
  modified_base 1..19: /mod_base = "2'-hydroxy corresponding base"
cacuguuacccguaaaaautt

SEQ ID NO: 1127 - DNA, 21 bp, Artificial sequence
  siRNAs to PCSK9
  modified_base 1..19: /mod_base = "2'-hydroxy corresponding base"
uuuacggguaacagugaggtt

SEQ ID NO: 1128 - DNA, 21 bp, Artificial sequence
  siRNAs to PCSK9
  modified_base 1..19: /mod_base = "2'-hydroxy corresponding base"
ccucacuguuacccguaaatt

SEQ ID NO: 1129 - DNA, 21 bp, Artificial sequence
  siRNAs to PCSK9
  modified_base 1..19: /mod_base = "2'-hydroxy corresponding base"
cagaccaggaagcucggugtt

SEQ ID NO: 1130 - DNA, 21 bp, Artificial sequence
  siRNAs to PCSK9
  modified_base 1..19: /mod_base = "2'-hydroxy corresponding base"
caccgagcuuccuggucugtt

SEQ ID NO: 1131 - DNA, 21 bp, Artificial sequence
  siRNAs to PCSK9
  modified_base 1..19: /mod_base = "2'-hydroxy corresponding base"
gaccaggaagcucggugagtt

SEQ ID NO: 1132 - DNA, 21 bp, Artificial sequence
  siRNAs to PCSK9
  modified_base 1..19: /mod_base = "2'-hydroxy corresponding base"
cucaccgagcuuccugguctt

SEQ ID NO: 1133 - DNA, 21 bp, Artificial sequence
  siRNAs to PCSK9
  modified_base 1..19: /mod_base = "2'-hydroxy corresponding base"
ccaggaagcucggugagugtt

SEQ ID NO: 1134 - DNA, 21 bp, Artificial sequence
  siRNAs to PCSK9
  modified_base 1..19: /mod_base = "2'-hydroxy corresponding base"
cacucaccgagcuuccuggtt

SEQ ID NO: 1135 - DNA, 21 bp, Artificial sequence
  siRNAs to PCSK9
  modified_base 1..19: /mod_base = "2'-hydroxy corresponding base"
ggaagcucggugagugaugtt

SEQ ID NO: 1136 - DNA, 21 bp, Artificial sequence
  siRNAs to PCSK9
  modified_base 1..19: /mod_base = "2'-hydroxy corresponding base"
caucacucaccgagcuucctt

SEQ ID NO: 1137 - DNA, 21 bp, Artificial sequence
  siRNAs to PCSK9
  modified_base 1..19: /mod_base = "2'-hydroxy corresponding base"
gugagugauggcagaacgatt

SEQ ID NO: 1138 - DNA, 21 bp, Artificial sequence
  siRNAs to PCSK9
  modified_base 1..19: /mod_base = "2'-hydroxy corresponding base"
ucguucugccaucacucactt

SEQ ID NO: 1139 - DNA, 21 bp, Artificial sequence
  siRNAs to PCSK9
  modified_base 1..19: /mod_base = "2'-hydroxy corresponding base"
gagugauggcagaacgaugtt

SEQ ID NO: 1140 - DNA, 21 bp, Artificial sequence
  siRNAs to PCSK9
  modified_base 1..19: /mod_base = "2'-hydroxy corresponding base"
caucguucugccaucacuctt

SEQ ID NO: 1141 - DNA, 21 bp, Artificial sequence
  siRNAs to PCSK9
  modified_base 1..19: /mod_base = "2'-hydroxy corresponding base"
gauggcagaacgaugccugtt

SEQ ID NO: 1142 - DNA, 21 bp, Artificial sequence
  siRNAs to PCSK9
  modified_base 1..19: /mod_base = "2'-hydroxy corresponding base"
caggcaucguucugccauctt

SEQ ID NO: 1143 - DNA, 21 bp, Artificial sequence
  siRNAs to PCSK9
  modified_base 1..19: /mod_base = "2'-hydroxy corresponding base"
agaacgaugccugcaggcatt

SEQ ID NO: 1144 - DNA, 21 bp, Artificial sequence
  siRNAs to PCSK9
  modified_base 1..19: /mod_base = "2'-hydroxy corresponding base"
ugccugcaggcaucguucutt

SEQ ID NO: 1145 - DNA, 21 bp, Artificial sequence
  siRNAs to PCSK9
  modified_base 1..19: /mod_base = "2'-hydroxy corresponding base"
acgaugccugcaggcauggtt

SEQ ID NO: 1146 - DNA, 21 bp, Artificial sequence
  siRNAs to PCSK9
  modified_base 1..19: /mod_base = "2'-hydroxy corresponding base"
ccaugccugcaggcaucgutt

SEQ ID NO: 1147 - DNA, 21 bp, Artificial sequence
  siRNAs to PCSK9
  modified_base 1..19: /mod_base = "2'-hydroxy corresponding base"
gcaggcauggaacuuuuuctt

SEQ ID NO: 1148 - DNA, 21 bp, Artificial sequence
  siRNAs to PCSK9
  modified_base 1..19: /mod_base = "2'-hydroxy corresponding base"
gaaaaaguuccaugccugctt

SEQ ID NO: 1149 - DNA, 21 bp, Artificial sequence
  siRNAs to PCSK9
  modified_base 1..19: /mod_base = "2'-hydroxy corresponding base"
ggaacuuuuuccguuaucatt

SEQ ID NO: 1150 - DNA, 21 bp, Artificial sequence
  siRNAs to PCSK9
  modified_base 1..19: /mod_base = "2'-hydroxy corresponding base"
ugauaacggaaaaaguucctt

SEQ ID NO: 1151 - DNA, 21 bp, Artificial sequence
  siRNAs to PCSK9
  modified_base 1..19: /mod_base = "2'-hydroxy corresponding base"
gaacuuuuuccguuaucactt

SEQ ID NO: 1152 - DNA, 21 bp, Artificial sequence
  siRNAs to PCSK9
  modified_base 1..19: /mod_base = "2'-hydroxy corresponding base"
gugauaacggaaaaaguuctt

SEQ ID NO: 1153 - DNA, 21 bp, Artificial sequence
  siRNAs to PCSK9
  modified_base 1..19: /mod_base = "2'-hydroxy corresponding base"
aacuuuuuccguuaucacctt

SEQ ID NO: 1154 - DNA, 21 bp, Artificial sequence
  siRNAs to PCSK9
  modified_base 1..19: /mod_base = "2'-hydroxy corresponding base"
ggugauaacggaaaaaguutt

SEQ ID NO: 1155 - DNA, 21 bp, Artificial sequence
  siRNAs to PCSK9
  modified_base 1..19: /mod_base = "2'-hydroxy corresponding base"
uaucacccaggccugauuctt

SEQ ID NO: 1156 - DNA, 21 bp, Artificial sequence
  siRNAs to PCSK9
  modified_base 1..19: /mod_base = "2'-hydroxy corresponding base"
gaaucaggccugggugauatt

SEQ ID NO: 1157 - DNA, 21 bp, Artificial sequence
  siRNAs to PCSK9
  modified_base 1..19: /mod_base = "2'-hydroxy corresponding base"
aggccugauucacuggccutt

SEQ ID NO: 1158 - DNA, 21 bp, Artificial sequence
  siRNAs to PCSK9
  modified_base 1..19: /mod_base = "2'-hydroxy corresponding base"
aggccagugaaucaggccutt

SEQ ID NO: 1159 - DNA, 21 bp, Artificial sequence
  siRNAs to PCSK9
  modified_base 1..19: /mod_base = "2'-hydroxy corresponding base"
ugauucacuggccuggcggtt

SEQ ID NO: 1160 - DNA, 21 bp, Artificial sequence
  siRNAs to PCSK9
  modified_base 1..19: /mod_base = "2'-hydroxy corresponding base"
ccgccaggccagugaaucatt

SEQ ID NO: 1161 - DNA, 21 bp, Artificial sequence
  siRNAs to PCSK9
  modified_base 1..19: /mod_base = "2'-hydroxy corresponding base"
auucacuggccuggcggagtt

SEQ ID NO: 1162 - DNA, 21 bp, Artificial sequence
  siRNAs to PCSK9
  modified_base 1..19: /mod_base = "2'-hydroxy corresponding base"
cuccgccaggccagugaautt

SEQ ID NO: 1163 - DNA, 21 bp, Artificial sequence
  siRNAs to PCSK9
  modified_base 1..19: /mod_base = "2'-hydroxy corresponding base"
gcuucuaaggcauggucggtt

SEQ ID NO: 1164 - DNA, 21 bp, Artificial sequence
  siRNAs to PCSK9
  modified_base 1..19: /mod_base = "2'-hydroxy corresponding base"
ccgaccaugccuuagaagctt

SEQ ID NO: 1165 - DNA, 21 bp, Artificial sequence
  siRNAs to PCSK9
  modified_base 1..19: /mod_base = "2'-hydroxy corresponding base"
cuucuaaggcauggucgggtt

SEQ ID NO: 1166 - DNA, 21 bp, Artificial sequence
  siRNAs to PCSK9
  modified_base 1..19: /mod_base = "2'-hydroxy corresponding base"
cccgaccaugccuuagaagtt

SEQ ID NO: 1167 - DNA, 21 bp, Artificial sequence
  siRNAs to PCSK9
  modified_base 1..19: /mod_base = "2'-hydroxy corresponding base"
gagggccaacaacuguccctt

SEQ ID NO: 1168 - DNA, 21 bp, Artificial sequence
  siRNAs to PCSK9
  modified_base 1..19: /mod_base = "2'-hydroxy corresponding base"
gggacaguuguuggcccuctt

SEQ ID NO: 1169 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
acugucccuccuugagcactt

SEQ ID NO: 1170 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gugcucaaggagggacagutt

SEQ ID NO: 1171 - DNA, 21 bp, Artificial sequence
  siRNAs to PCSK9
  modified_base 2, 3, 5, 6, 7, 8, 9, 10, 11, 12, 13, 17, 19: /mod_base = "2'-O-methyl corresponding base"
  modified_base 21: /mod_base = "5'-thio thymidine"
  modified_base 1, 4, 14, 15, 16, 18: /mod_base = "2'-hydroxy corresponding base"
acugucccuccuugagcactt

SEQ ID NO: 1172 - DNA, 21 bp, Artificial sequence
  siRNAs to PCSK9
  modified_base 6, 16: /mod_base = "2'-O-methyl corresponding base"
  modified_base 21: /mod_base = "5'-thio thymidine"
  modified_base 1, 2, 3, 4, 5, 7, 8, 9, 10, 11, 12, 13, 14, 15, 17, 18, 19: /mod_base = "2'-hydroxy corresponding base"
gugcucaaggagggacagutt

SEQ ID NO: 1173 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cugucccuccuugagcacctt

SEQ ID NO: 1174 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ggugcucaaggagggacagtt

SEQ ID NO: 1175 - DNA, 21 bp, Artificial sequence
  siRNAs to PCSK9
  modified_base 1, 2, 4, 5, 6, 7, 8, 9, 10, 11, 12, 16, 18, 19: /mod_base = "2'-O-methyl corresponding base"
  modified_base 21: /mod_base = "5'-thio thymidine"
  modified_base 3, 13, 14, 15, 17: /mod_base = "2'-hydroxy corresponding base"
cugucccuccuugagcacctt

SEQ ID NO: 1176 - DNA, 21 bp, Artificial sequence
  siRNAs to PCSK9
  modified_base 7, 17: /mod_base = "2'-O-methyl corresponding base"
  modified_base 21: /mod_base = "5'-thio thymidine"
  modified_base 1, 2, 3, 4, 5, 6, 8, 9, 10, 11, 12, 13, 14, 15, 16, 18, 19: /mod_base = "2'-hydroxy corresponding base"
ggugcucaaggagggacagtt

SEQ ID NO: 1177 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
acauuuaucuuuugggucutt

SEQ ID NO: 1178 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
agacccaaaagauaaaugutt

SEQ ID NO: 1179 - DNA, 21 bp, Artificial sequence
  siRNAs to PCSK9
  modified_base 2, 4, 5, 6, 8, 9, 10, 11, 12, 13, 17, 18, 19: /mod_base = "2'-O-methyl corresponding base"
  modified_base 21: /mod_base = "5'-thio thymidine"
  modified_base 1, 3, 7, 14, 15, 16: /mod_base = "2'-hydroxy corresponding base"
acauuuaucuuuugggucutt

SEQ ID NO: 1180 - DNA, 21 bp, Artificial sequence
  siRNAs to PCSK9
  modified_base 6, 13: /mod_base = "2'-O-methyl corresponding base"
  modified_base 21: /mod_base = "5'-thio thymidine"
  modified_base 1, 2, 3, 4, 5, 7, 8, 9, 10, 11, 12, 14, 15, 16, 17, 18, 19: /mod_base = "2'-hydroxy corresponding base"
agacccaaaagauaaaugutt

SEQ ID NO: 1181 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
acauuuaucuuuugggucutt

SEQ ID NO: 1182 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
agacccaaaagauaaaugutt

SEQ ID NO: 1183 - DNA, 21 bp, Artificial sequence
  siRNAs to PCSK9
  modified_base 2, 4, 5, 6, 8, 9, 10, 11, 12, 13, 17, 18, 19: /mod_base = "2'-deoxy-2'-fluoro corresponding base"
  modified_base 21: /mod_base = "5'-thio thymidine"
  modified_base 1, 3, 7, 14, 15, 16: /mod_base = "2'-hydroxy corresponding base"
acauuuaucuuuugggucutt

SEQ ID NO: 1184 - DNA, 21 bp, Artificial sequence
  siRNAs to PCSK9
  modified_base 4, 5, 6, 13, 17, 19: /mod_base = "2'-deoxy-2'-fluoro corresponding base"
  modified_base 21: /mod_base = "5'-thio thymidine"
  modified_base 1, 2, 3, 7, 8, 9, 10, 11, 12, 14, 15, 16, 18: /mod_base = "2'-hydroxy corresponding base"
agacccaaaagauaaaugutt

SEQ ID NO: 1185 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
acauuuaucuuuugggucutt

SEQ ID NO: 1186 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
agacccaaaagauaaaugutt

SEQ ID NO: 1187 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
acauuuaucuuuugggucutt

SEQ ID NO: 1188 - DNA, 21 bp, Artificial sequence
  siRNAs to PCSK9
  modified_base 4, 5, 6, 13, 17, 19: /mod_base = "2'-deoxy-2'-fluoro corresponding base"
  modified_base 21: /mod_base = "5'-thio thymidine"
  modified_base 1, 2, 3, 7, 8, 9, 10, 11, 12, 14, 15, 16, 18: /mod_base = "2'-hydroxy corresponding base"
agacccaaaagauaaaugutt

SEQ ID NO: 1189 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
acauuuaucuuuugggucutt

SEQ ID NO: 1190 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
agacccaaaagauaaaugutt

SEQ ID NO: 1191 - DNA, 21 bp, Artificial sequence
  siRNAs to PCSK9
  modified_base 2, 4, 5, 6, 8, 9, 10, 11, 12, 13, 17, 18, 19: /mod_base = "2'-deoxy-2'-fluoro corresponding base"
  modified_base 21: /mod_base = "5'-thio thymidine"
  modified_base 1, 3, 7, 14, 15, 16: /mod_base = "2'-hydroxy corresponding base"
acauuuaucuuuugggucutt

SEQ ID NO: 1192 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
agacccaaaagauaaaugutt

SEQ ID NO: 1193 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
acauuuaucuuuugggucutt

SEQ ID NO: 1194 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
agacccaaaagauaaaugutt

SEQ ID NO: 1195 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
gccaucugcugccggagcctt

SEQ ID NO: 1196 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
ggcuccggcagcagauggctt

SEQ ID NO: 1197 - DNA, 21 bp, Artificial sequence
  siRNAs to PCSK9
  modified_base 2, 3, 5, 6, 7, 9, 10, 12, 13, 18, 19: /mod_base = "2'-deoxy-2'-fluoro corresponding base"
  modified_base 21: /mod_base = "5'-thio thymidine"
  modified_base 1, 4, 8, 11, 14, 15, 16, 17: /mod_base = "2'-hydroxy corresponding base"
gccaucugcugccggagcctt

SEQ ID NO: 1198 - DNA, 21 bp, Artificial sequence
  siRNAs to PCSK9
  modified_base 3, 4, 5, 6, 9, 12, 16, 19: /mod_base = "2'-deoxy-2'-fluoro corresponding base"
  modified_base 21: /mod_base = "5'-thio thymidine"
  modified_base 1, 2, 7, 8, 10, 11, 13, 14, 15, 17, 18: /mod_base = "2'-hydroxy corresponding base"
ggcuccggcagcagauggctt

SEQ ID NO: 1199 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
gccaucugcugccggagcctt

SEQ ID NO: 1200 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
ggcuccggcagcagauggctt

SEQ ID NO: 1201 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
gccaucugcugccggagcctt

SEQ ID NO: 1202 - DNA, 21 bp, Artificial sequence
  siRNAs to PCSK9
  modified_base 3, 4, 5, 6, 9, 12, 16, 19: /mod_base = "2'-deoxy-2'-fluoro corresponding base"
  modified_base 21: /mod_base = "5'-thio thymidine"
  modified_base 1, 2, 7, 8, 10, 11, 13, 14, 15, 17, 18: /mod_base = "2'-hydroxy corresponding base"
ggcuccggcagcagauggctt

SEQ ID NO: 1203 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
gccaucugcugccggagcctt

SEQ ID NO: 1204 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
ggcucaugcagcagauggctt

SEQ ID NO: 1205 - DNA, 21 bp, Artificial sequence
  siRNAs to PCSK9
  modified_base 2, 3, 5, 6, 7, 9, 10, 12, 13, 18, 19: /mod_base = "2'-deoxy-2'-fluoro corresponding base"
  modified_base 21: /mod_base = "5'-thio thymidine"
  modified_base 1, 4, 8, 11, 14, 15, 16, 17: /mod_base = "2'-hydroxy corresponding base"
gccaucugcugccggagcctt

SEQ ID NO: 1206 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
ggcucaugcagcagauggctt

SEQ ID NO: 1207 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
gccaucugcugccggagcctt

SEQ ID NO: 1208 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
ggcucaugcagcagauggctt

SEQ ID NO: 1209 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cauuuaucuuuugggucugtt

SEQ ID NO: 1210 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cagacccaaaagauaaaugtt

SEQ ID NO: 1211 - DNA, 21 bp, Artificial sequence
  siRNAs to PCSK9
  modified_base 1, 3, 4, 5, 7, 8, 9, 10, 11, 12, 16, 17, 18: /mod_base = "2'-O-methyl corresponding base"
  modified_base 21: /mod_base = "5'-thio thymidine"
  modified_base 2, 6, 13, 14, 15, 19: /mod_base = "2'-hydroxy corresponding base"
cauuuaucuuuugggucugtt

SEQ ID NO: 1212 - DNA, 21 bp, Artificial sequence
  siRNAs to PCSK9
  modified_base 1, 7, 14: /mod_base = "2'-O-methyl corresponding base"
  modified_base 21: /mod_base = "5'-thio thymidine"
  modified_base 2, 3, 4, 5, 6, 8, 9, 10, 11, 12, 13, 15, 16, 17, 18, 19: /mod_base = "2'-hydroxy corresponding base"
cagacccaaaagauaaaugtt

SEQ ID NO: 1213 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uaucuuuugggucuguccutt

SEQ ID NO: 1214 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
aggacagacccaaaagauatt

SEQ ID NO: 1215 - DNA, 21 bp, Artificial sequence
  siRNAs to PCSK9
  modified_base 1, 3, 4, 5, 6, 7, 8, 12, 13, 14, 16, 17, 18, 19: /mod_base = "2'-O-methyl corresponding base"
  modified_base 21: /mod_base = "5'-thio thymidine"
  modified_base 2, 9, 10, 11, 15: /mod_base = "2'-hydroxy corresponding base"
uaucuuuugggucuguccutt

SEQ ID NO: 1216 - DNA, 21 bp, Artificial sequence
  siRNAs to PCSK9
  modified_base 5, 11, 18: /mod_base = "2'-O-methyl corresponding base"
  modified_base 21: /mod_base = "5'-thio thymidine"
  modified_base 1, 2, 3, 4, 6, 7, 8, 9, 10, 12, 13, 14, 15, 16, 17, 19: /mod_base = "2'-hydroxy corresponding base"
aggacagacccaaaagauatt

SEQ ID NO: 1217 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cucuguugccuuuuuacagtt

SEQ ID NO: 1218 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cuguaaaaaggcaacagagtt

SEQ ID NO: 1219 - DNA, 21 bp, Artificial sequence
  siRNAs to PCSK9
  modified_base 1, 2, 3, 4, 6, 7, 9, 10, 11, 12, 13, 14, 15, 17: /mod_base = "2'-O-methyl corresponding base"
  modified_base 21: /mod_base = "5'-thio thymidine"
  modified_base 5, 8, 16, 18, 19: /mod_base = "2'-hydroxy corresponding base"
cucuguugccuuuuuacagtt

SEQ ID NO: 1220 - DNA, 21 bp, Artificial sequence
  siRNAs to PCSK9
  modified_base 4, 12, 15: /mod_base = "2'-O-methyl corresponding base"
  modified_base 21: /mod_base = "5'-thio thymidine"
  modified_base 1, 2, 3, 5, 6, 7, 8, 9, 10, 11, 13, 14, 16, 17, 18, 19: /mod_base = "2'-hydroxy corresponding base"
cuguaaaaaggcaacagagtt

SEQ ID NO: 1221 - DNA, 21 bp, Artificial sequence
  siRNAs to PCSK9
  modified_base 1..19: /mod_base = "2'-hydroxy corresponding base"
ccuuuuuacagccaacuuutt

SEQ ID NO: 1222 - DNA, 21 bp, Artificial sequence
  siRNAs to PCSK9
  modified_base 1..19: /mod_base = "2'-hydroxy corresponding base"
aaaguuggcuguaaaaaggtt

SEQ ID NO: 1223 - DNA, 21 bp, Artificial sequence
  siRNAs to PCSK9
  modified_base 1..19: /mod_base = "2'-hydroxy corresponding base"
agccaacuuuucuagaccutt

SEQ ID NO: 1224 - DNA, 21 bp, Artificial sequence
  siRNAs to PCSK9
  modified_base 1..19: /mod_base = "2'-hydroxy corresponding base"
aggucuagaaaaguuggcutt

SEQ ID NO: 1225 - DNA, 21 bp, Artificial sequence
  siRNAs to PCSK9
  modified_base 1..19: /mod_base = "2'-hydroxy corresponding base"
acuuuucuagaccuguuuutt

SEQ ID NO: 1226 - DNA, 21 bp, Artificial sequence
  siRNAs to PCSK9
  modified_base 1..19: /mod_base = "2'-hydroxy corresponding base"
aaaacaggucuagaaaagutt

SEQ ID NO: 1227 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uucuagaccuguuuugcuutt

SEQ ID NO: 1228 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
aagcaaaacaggucuagaatt

SEQ ID NO: 1229 - DNA, 21 bp, Artificial sequence
  siRNAs to PCSK9
  modified_base 1, 2, 3, 4, 8, 9, 10, 12, 13, 14, 15, 17, 18, 19: /mod_base = "2'-O-methyl corresponding base"
  modified_base 21: /mod_base = "5'-thio thymidine"
  modified_base 5, 6, 7, 11, 16: /mod_base = "2'-hydroxy corresponding base"
uucuagaccuguuuugcuutt

SEQ ID NO: 1230 - DNA, 21 bp, Artificial sequence
  siRNAs to PCSK9
  modified_base 4, 9, 15: /mod_base = "2'-O-methyl corresponding base"
  modified_base 21: /mod_base = "5'-thio thymidine"
  modified_base 1, 2, 3, 5, 6, 7, 8, 10, 11, 12, 13, 14, 16, 17, 18, 19: /mod_base = "2'-hydroxy corresponding base"
aagcaaaacaggucuagaatt

SEQ ID NO: 1231 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
uucuagaccuguuuugcuutt

SEQ ID NO: 1232 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
aagcaaaacaggucuagaatt

SEQ ID NO: 1233 - DNA, 21 bp, Artificial sequence
  siRNAs to PCSK9
  modified_base 1, 2, 3, 4, 8, 9, 10, 12, 13, 14, 15, 17, 18, 19: /mod_base = "2'-deoxy-2'-fluoro corresponding base"
  modified_base 21: /mod_base = "5'-thio thymidine"
  modified_base 5, 6, 7, 11, 16: /mod_base = "2'-hydroxy corresponding base"
uucuagaccuguuuugcuutt

SEQ ID NO: 1234 - DNA, 21 bp, Artificial sequence
  siRNAs to PCSK9
  modified_base 4, 9, 13, 14, 15: /mod_base = "2'-deoxy-2'-fluoro corresponding base"
  modified_base 21: /mod_base = "5'-thio thymidine"
  modified_base 1, 2, 3, 5, 6, 7, 8, 10, 11, 12, 16, 17, 18, 19: /mod_base = "2'-hydroxy corresponding base"
aagcaaaacaggucuagaatt

SEQ ID NO: 1235 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
uucuagaccuguuuugcuutt

SEQ ID NO: 1236 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
aagcaaaacaggucuagaatt

SEQ ID NO: 1237 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
uucuagaccuguuuugcuutt

SEQ ID NO: 1238 - DNA, 21 bp, Artificial sequence
  siRNAs to PCSK9
  modified_base 4, 9, 13, 14, 15: /mod_base = "2'-deoxy-2'-fluoro corresponding base"
  modified_base 21: /mod_base = "5'-thio thymidine"
  modified_base 1, 2, 3, 5, 6, 7, 8, 10, 11, 12, 16, 17, 18, 19: /mod_base = "2'-hydroxy corresponding base"
aagcaaaacaggucuagaatt

SEQ ID NO: 1239 - DNA, 20 bp, Artificial sequence
  siRNAs to PCSK9
  modified_base 2, 4, 6, 8, 10, 12, 14, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
uucuagaccuguuuucuutt

SEQ ID NO: 1240 - DNA, 21 bp, Artificial sequence
  siRNAs to PCSK9
  modified_base 4, 6, 7, 10, 11, 17, 18, 19: /mod_base = "2'-O-methyl corresponding base"
  modified_base 21: /mod_base = "5'-thio thymidine"
  modified_base 1, 2, 3, 5, 8, 9, 12, 13, 14, 15, 16: /mod_base = "2'-hydroxy corresponding base"
aagcaaaacaggucuagaatt

SEQ ID NO: 1241 - DNA, 21 bp, Artificial sequence
  siRNAs to PCSK9
  modified_base 1, 2, 3, 4, 8, 9, 10, 12, 13, 14, 15, 17, 18, 19: /mod_base = "2'-deoxy-2'-fluoro corresponding base"
  modified_base 21: /mod_base = "5'-thio thymidine"
  modified_base 5, 6, 7, 11, 16: /mod_base = "2'-hydroxy corresponding base"
uucuagaccuguuuugcuutt

SEQ ID NO: 1242 - DNA, 21 bp, Artificial sequence
  siRNAs to PCSK9
  modified_base 4, 6, 7, 10, 11, 17, 18, 19: /mod_base = "2'-O-methyl corresponding base"
  modified_base 21: /mod_base = "5'-thio thymidine"
  modified_base 1, 2, 3, 5, 8, 9, 12, 13, 14, 15, 16: /mod_base = "2'-hydroxy corresponding base"
aagcaaaacaggucuagaatt

SEQ ID NO: 1243 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
uucuagaccuguuuugcuutt

SEQ ID NO: 1244 - DNA, 21 bp, Artificial sequence
  siRNAs to PCSK9
  modified_base 4, 6, 7, 10, 11, 17, 18, 19: /mod_base = "2'-O-methyl corresponding base"
  modified_base 21: /mod_base = "5'-thio thymidine"
  modified_base 1, 2, 3, 5, 8, 9, 12, 13, 14, 15, 16: /mod_base = "2'-hydroxy corresponding base"
aagcaaaacaggucuagaatt

SEQ ID NO: 1245 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
cauaggccuggaguuuauutt

SEQ ID NO: 1246 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
aauaaacuccaggccuaugtt

SEQ ID NO: 1247 - DNA, 21 bp, Artificial sequence
  siRNAs to PCSK9
  modified_base 1, 3, 7, 8, 9, 14, 15, 16, 18, 19: /mod_base = "2'-deoxy-2'-fluoro corresponding base"
  modified_base 21: /mod_base = "5'-thio thymidine"
  modified_base 2, 4, 5, 6, 10, 11, 12, 13, 17: /mod_base = "2'-hydroxy corresponding base"
cauaggccuggaguuuauutt

SEQ ID NO: 1248 - DNA, 21 bp, Artificial sequence
  siRNAs to PCSK9
  modified_base 3, 7, 8, 9, 10, 14, 15, 16, 18: /mod_base = "2'-deoxy-2'-fluoro corresponding base"
  modified_base 21: /mod_base = "5'-thio thymidine"
  modified_base 1, 2, 4, 5, 6, 11, 12, 13, 17, 19: /mod_base = "2'-hydroxy corresponding base"
aauaaacuccaggccuaugtt

SEQ ID NO: 1249 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
cauaggccuggaguuuauutt

SEQ ID NO: 1250 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
aauaaacuccaggccuaugtt

SEQ ID NO: 1251 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
cauaggccuggaguuuauutt

SEQ ID NO: 1252 - DNA, 21 bp, Artificial sequence
  siRNAs to PCSK9
  modified_base 3, 7, 8, 9, 10, 14, 15, 16, 18: /mod_base = "2'-deoxy-2'-fluoro corresponding base"
  modified_base 21: /mod_base = "5'-thio thymidine"
  modified_base 1, 2, 4, 5, 6, 11, 12, 13, 17, 19: /mod_base = "2'-hydroxy corresponding base"
aauaaacuccaggccuaugtt

SEQ ID NO: 1253 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
cauaggccuggaguuuauutt

SEQ ID NO: 1254 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
aauaaacuccaggccuaugtt

SEQ ID NO: 1255 - DNA, 21 bp, Artificial sequence
  siRNAs to PCSK9
  modified_base 1, 3, 7, 8, 9, 14, 15, 16, 18, 19: /mod_base = "2'-deoxy-2'-fluoro corresponding base"
  modified_base 21: /mod_base = "5'-thio thymidine"
  modified_base 2, 4, 5, 6, 10, 11, 12, 13, 17: /mod_base = "2'-hydroxy corresponding base"
cauaggccuggaguuuauutt

SEQ ID NO: 1256 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
aauaaacuccaggccuaugtt

SEQ ID NO: 1257 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
cauaggccuggaguuuauutt

SEQ ID NO: 1258 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
aauaaacuccaggccuaugtt

SEQ ID NO: 1259 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ucuagaccuguuuugcuuutt

SEQ ID NO: 1260 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
aaagcaaaacaggucuagatt

SEQ ID NO: 1261 - DNA, 21 bp, Artificial sequence
  siRNAs to PCSK9
  modified_base 1, 2, 3, 7, 8, 9, 11, 12, 13, 14, 16, 17, 18, 19: /mod_base = "2'-O-methyl corresponding base"
  modified_base 21: /mod_base = "5'-thio thymidine"
  modified_base 4, 5, 6, 10, 15: /mod_base = "2'-hydroxy corresponding base"
ucuagaccuguuuugcuuutt

SEQ ID NO: 1262 - DNA, 21 bp, Artificial sequence
  siRNAs to PCSK9
  modified_base 5, 10, 16: /mod_base = "2'-O-methyl corresponding base"
  modified_base 21: /mod_base = "5'-thio thymidine"
  modified_base 1, 2, 3, 4, 6, 7, 8, 9, 11, 12, 13, 14, 15, 17, 18, 19: /mod_base = "2'-hydroxy corresponding base"
aaagcaaaacaggucuagatt

SEQ ID NO: 1263 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
ucuagaccuguuuugcuuutt

SEQ ID NO: 1264 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
aaagcaaaacaggucuagatt

SEQ ID NO: 1265 - DNA, 21 bp, Artificial sequence
  siRNAs to PCSK9
  modified_base 1, 2, 3, 7, 8, 9, 11, 12, 13, 14, 16, 17, 18, 19: /mod_base = "2'-deoxy-2'-fluoro corresponding base"
  modified_base 21: /mod_base = "5'-thio thymidine"
  modified_base 4, 5, 6, 10, 15: /mod_base = "2'-hydroxy corresponding base"
ucuagaccuguuuugcuuutt

SEQ ID NO: 1266 - DNA, 21 bp, Artificial sequence
  siRNAs to PCSK9
  modified_base 5, 10, 14, 15, 16: /mod_base = "2'-deoxy-2'-fluoro corresponding base"
  modified_base 21: /mod_base = "5'-thio thymidine"
  modified_base 1, 2, 3, 4, 6, 7, 8, 9, 11, 12, 13, 17, 18, 19: /mod_base = "2'-hydroxy corresponding base"
aaagcaaaacaggucuagatt

SEQ ID NO: 1267 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ucuagaccuguuuugcuuutt

SEQ ID NO: 1268 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
aaagcaaaacaggucuagatt

SEQ ID NO: 1269 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ucuagaccuguuuugcuuutt

SEQ ID NO: 1270 - DNA, 21 bp, Artificial sequence
  siRNAs to PCSK9
  modified_base 5, 10, 14, 15, 16: /mod_base = "2'-deoxy-2'-fluoro corresponding base"
  modified_base 21: /mod_base = "5'-thio thymidine"
  modified_base 1, 2, 3, 4, 6, 7, 8, 9, 11, 12, 13, 17, 18, 19: /mod_base = "2'-hydroxy corresponding base"
aaagcaaaacaggucuagatt

SEQ ID NO: 1271 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
ucuagaccuguuuugcuuutt

SEQ ID NO: 1272 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
aaagcaaaacaggucuagatt

SEQ ID NO: 1273 - DNA, 21 bp, Artificial sequence
  siRNAs to PCSK9
  modified_base 1, 2, 3, 7, 8, 9, 11, 12, 13, 14, 16, 17, 18, 19: /mod_base = "2'-deoxy-2'-fluoro corresponding base"
  modified_base 21: /mod_base = "5'-thio thymidine"
  modified_base 4, 5, 6, 10, 15: /mod_base = "2'-hydroxy corresponding base"
ucuagaccuguuuugcuuutt

SEQ ID NO: 1274 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
aaagcaaaacaggucuagatt

SEQ ID NO: 1275 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ucuagaccuguuuugcuuutt

SEQ ID NO: 1276 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
aaagcaaaacaggucuagatt

SEQ ID NO: 1277 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
ucauaggccuggaguuuautt

SEQ ID NO: 1278 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
auaaacuccaggccuaugatt

SEQ ID NO: 1279 - DNA, 21 bp, Artificial sequence
  siRNAs to PCSK9
  modified_base 1, 2, 4, 8, 9, 10, 15, 16, 17, 19: /mod_base = "2'-deoxy-2'-fluoro corresponding base"
  modified_base 21: /mod_base = "5'-thio thymidine"
  modified_base 3, 5, 6, 7, 11, 12, 13, 14, 18: /mod_base = "2'-hydroxy corresponding base"
ucauaggccuggaguuuautt

SEQ ID NO: 1280 - DNA, 21 bp, Artificial sequence
  siRNAs to PCSK9
  modified_base 2, 6, 7, 8, 9, 13, 14, 15, 17: /mod_base = "2'-deoxy-2'-fluoro corresponding base"
  modified_base 21: /mod_base = "5'-thio thymidine"
  modified_base 1, 3, 4, 5, 10, 11, 12, 16, 18, 19: /mod_base = "2'-hydroxy corresponding base"
auaaacuccaggccuaugatt

SEQ ID NO: 1281 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ucauaggccuggaguuuautt

SEQ ID NO: 1282 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
auaaacuccaggccuaugatt

SEQ ID NO: 1283 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ucauaggccuggaguuuautt

SEQ ID NO: 1284 - DNA, 21 bp, Artificial sequence
  siRNAs to PCSK9
  modified_base 2, 6, 7, 8, 9, 13, 14, 15, 17: /mod_base = "2'-deoxy-2'-fluoro corresponding base"
  modified_base 21: /mod_base = "5'-thio thymidine"
  modified_base 1, 3, 4, 5, 10, 11, 12, 16, 18, 19: /mod_base = "2'-hydroxy corresponding base"
auaaacuccaggccuaugatt

SEQ ID NO: 1285 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
ucauaggccuggaguuuautt

SEQ ID NO: 1286 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
auaaacuccaggccuaugatt

SEQ ID NO: 1287 - DNA, 21 bp, Artificial sequence
  siRNAs to PCSK9
  modified_base 1, 2, 4, 8, 9, 10, 15, 16, 17, 19: /mod_base = "2'-deoxy-2'-fluoro corresponding base"
  modified_base 21: /mod_base = "5'-thio thymidine"
  modified_base 3, 5, 6, 7, 11, 12, 13, 14, 18: /mod_base = "2'-hydroxy corresponding base"
ucauaggccuggaguuuautt

SEQ ID NO: 1288 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
auaaacuccaggccuaugatt

SEQ ID NO: 1289 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
ucauaggccuggaguuuautt

SEQ ID NO: 1290 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
auaaacuccaggccuaugatt

SEQ ID NO: 1291 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ugaagauauuuauucugggtt

SEQ ID NO: 1292 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
cccagaauaaauaucuucatt

SEQ ID NO: 1293 - DNA, 21 bp, Artificial sequence
  siRNAs to PCSK9
  modified_base 1, 7, 9, 10, 11, 13, 14, 15, 16: /mod_base = "2'-O-methyl corresponding base"
  modified_base 21: /mod_base = "5'-thio thymidine"
  modified_base 2, 3, 4, 5, 6, 8, 12, 17, 18, 19: /mod_base = "2'-hydroxy corresponding base"
ugaagauauuuauucugggtt

SEQ ID NO: 1294 - DNA, 21 bp, Artificial sequence
  siRNAs to PCSK9
  modified_base 3, 8, 12, 18: /mod_base = "2'-O-methyl corresponding base"
  modified_base 21: /mod_base = "5'-thio thymidine"
  modified_base 1, 2, 4, 5, 6, 7, 9, 10, 11, 13, 14, 15, 16, 17, 19: /mod_base = "2'-hydroxy corresponding base"
cccagaauaaauaucuucatt

SEQ ID NO: 1295 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
ucuggguuuuguagcauuutt

SEQ ID NO: 1296 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
aaaugcuacaaaacccagatt

SEQ ID NO: 1297 - DNA, 21 bp, Artificial sequence
  siRNAs to PCSK9
  modified_base 1, 2, 3, 7, 8, 9, 10, 12, 15, 17, 18, 19: /mod_base = "2'-O-methyl corresponding base"
  modified_base 21: /mod_base = "5'-thio thymidine"
  modified_base 4, 5, 6, 11, 13, 14, 16: /mod_base = "2'-hydroxy corresponding base"
ucuggguuuuguagcauuutt

SEQ ID NO: 1298 - DNA, 21 bp, Artificial sequence
  siRNAs to PCSK9
  modified_base 7, 9, 16: /mod_base = "2'-O-methyl corresponding base"
  modified_base 21: /mod_base = "5'-thio thymidine"
  modified_base 1, 2, 3, 4, 5, 6, 8, 10, 11, 12, 13, 14, 15, 17, 18, 19: /mod_base = "2'-hydroxy corresponding base"
aaaugcuacaaaacccagatt

SEQ ID NO: 1299 - DNA, 21 bp, Artificial sequence
  siRNAs to PCSK9
  modified_base 1..19: /mod_base = "2'-hydroxy corresponding base"
auaaaaacaaacaaacguutt

SEQ ID NO: 1300 - DNA, 21 bp, Artificial sequence
  siRNAs to PCSK9
  modified_base 1..19: /mod_base = "2'-hydroxy corresponding base"
aacguuuguuuguuuuuautt

SEQ ID NO: 1301 - DNA, 21 bp, Artificial sequence
  siRNAs to PCSK9
  modified_base 1..19: /mod_base = "2'-hydroxy corresponding base"
aaacaaacaaacguugucctt

SEQ ID NO: 1302 - DNA, 21 bp, Artificial sequence
  siRNAs to PCSK9
  modified_base 1..19: /mod_base = "2'-hydroxy corresponding base"
ggacaacguuuguuuguuutt

SEQ ID NO: 1303 - DNA, 21 bp, Artificial sequence
  siRNAs to PCSK9
  modified_base 1..19: /mod_base = "2'-hydroxy corresponding base"
aacaaacaaacguuguccutt

SEQ ID NO: 1304 - DNA, 21 bp, Artificial sequence
  siRNAs to PCSK9
  modified_base 1..19: /mod_base = "2'-hydroxy corresponding base"
aggacaacguuuguuuguutt

SEQ ID NO: 1305 - DNA, 21 bp, Artificial sequence
  siRNAs to PCSK9
  5'-terminal nucleic acid is a nucleoside, i.e. base + sugar but lacking 5'-phosphate
  modified_base 2, 3, 4, 9, 10, 11, 13, 14, 15: /mod_base = "2'-O-methyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1306 - DNA, 21 bp, Artificial sequence
  siRNAs to PCSK9
  5'-terminal nucleic acid is a nucleoside, i.e. base + sugar but lacking 5'-phosphate
  modified_base 8, 15: /mod_base = "2'-O-methyl corresponding base"
  modified_base 21: /mod_base = "5'-thio thymidine"
  modified_base 1, 2, 3, 4, 5, 6, 7, 9, 10, 11, 12, 13, 14, 16, 17, 18, 19: /mod_base = "2'-hydroxy corresponding base"
uuccgaauaaacuccaggctt

SEQ ID NO: 1307 - DNA, 21 bp, Artificial sequence
  siRNAs to PCSK9
  5'-terminal nucleic acid is a nucleoside, i.e. base + sugar but lacking 5'-phosphate
  modified_base 2, 3, 4, 9, 10, 11, 13, 14, 15: /mod_base = "2'-O-methyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1308 - DNA, 21 bp, Artificial sequence
  siRNAs to PCSK9
  5'-terminal nucleic acid is a nucleoside, i.e. base + sugar but lacking 5'-phosphate
  modified_base 1, 3, 8, 14, 15: /mod_base = "2'-O-methyl corresponding base"
  modified_base 21: /mod_base = "5'-thio thymidine"
  modified_base 2, 4, 5, 6, 7, 9, 10, 11, 12, 13, 16, 17, 18, 19: /mod_base = "2'-hydroxy corresponding base"
uuccgaauaaacuccaggctt

SEQ ID NO: 1309 - DNA, 21 bp, Artificial sequence
  siRNAs to PCSK9
  5'-terminal nucleic acid is a nucleoside, i.e. base + sugar but lacking 5'-phosphate
  modified_base 2, 3, 4, 9, 10, 11, 13, 14, 15: /mod_base = "2'-O-methyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1310 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
uuccgaauaaacuccaggctt

SEQ ID NO: 1311 - DNA, 21 bp, Artificial sequence
  siRNAs to PCSK9
  5'-terminal nucleic acid is a nucleoside, i.e. base + sugar but lacking 5'-phosphate
  modified_base 2, 3, 4, 9, 10, 11, 13, 14, 15: /mod_base = "2'-O-methyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1312 - DNA, 21 bp, Artificial sequence
  siRNAs to PCSK9
  5'-terminal nucleic acid is a nucleoside, i.e. base + sugar but lacking 5'-phosphate
  modified_base 1: /mod_base = "2'-O-methyl corresponding base"
  modified_base 21: /mod_base = "5'-thio thymidine"
  modified_base 2..19: /mod_base = "2'-hydroxy corresponding base"
uuccgaauaaacuccaggctt

SEQ ID NO: 1313 - DNA, 21 bp, Artificial sequence
  siRNAs to PCSK9
  5'-terminal nucleic acid is a nucleoside, i.e. base + sugar but lacking 5'-phosphate
  modified_base 2, 3, 4, 9, 10, 11, 13, 14, 15: /mod_base = "2'-O-methyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1314 - DNA, 21 bp, Artificial sequence
  siRNAs to PCSK9
  5'-terminal nucleic acid is a nucleoside, i.e. base + sugar but lacking 5'-phosphate
  modified_base 2: /mod_base = "2'-O-methyl corresponding base"
  modified_base 21: /mod_base = "5'-thio thymidine"
  modified_base 1, 3, 4, 5, 6, 7, 8, 9, 10, 11, 12, 13, 14, 15, 16, 17, 18, 19: /mod_base = "2'-hydroxy corresponding base"
uuccgaauaaacuccaggctt

SEQ ID NO: 1315 - DNA, 21 bp, Artificial sequence
  siRNAs to PCSK9
  5'-terminal nucleic acid is a nucleoside, i.e. base + sugar but lacking 5'-phosphate
  modified_base 2, 3, 4, 9, 10, 11, 13, 14, 15: /mod_base = "2'-O-methyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1316 - DNA, 21 bp, Artificial sequence
  siRNAs to PCSK9
  5'-terminal nucleic acid is a nucleoside, i.e. base + sugar but lacking 5'-phosphate
  modified_base 3: /mod_base = "2'-O-methyl corresponding base"
  modified_base 21: /mod_base = "5'-thio thymidine"
  modified_base 1, 2, 4, 5, 6, 7, 8, 9, 10, 11, 12, 13, 14, 15, 16, 17, 18, 19: /mod_base = "2'-hydroxy corresponding base"
uuccgaauaaacuccaggctt

SEQ ID NO: 1317 - DNA, 21 bp, Artificial sequence
  siRNAs to PCSK9
  5'-terminal nucleic acid is a nucleoside, i.e. base + sugar but lacking 5'-phosphate
  modified_base 2, 3, 4, 9, 10, 11, 13, 14, 15: /mod_base = "2'-O-methyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1318 - DNA, 21 bp, Artificial sequence
  siRNAs to PCSK9
  5'-terminal nucleic acid is a nucleoside, i.e. base + sugar but lacking 5'-phosphate
  modified_base 4: /mod_base = "2'-O-methyl corresponding base"
  modified_base 21: /mod_base = "5'-thio thymidine"
  modified_base 1, 2, 3, 5, 6, 7, 8, 9, 10, 11, 12, 13, 14, 15, 16, 17, 18, 19: /mod_base = "2'-hydroxy corresponding base"
uuccgaauaaacuccaggctt

SEQ ID NO: 1319 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gccuggaguuuauucggaatt

SEQ ID NO: 1320 - DNA, 21 bp, Artificial sequence
  siRNAs to PCSK9
  5'-terminal nucleic acid is a nucleoside, i.e. base + sugar but lacking 5'-phosphate
  modified_base 1: /mod_base = "2'-O-methyl corresponding base"
  modified_base 21: /mod_base = "5'-thio thymidine"
  modified_base 2..19: /mod_base = "2'-hydroxy corresponding base"
uuccgaauaaacuccaggctt

SEQ ID NO: 1321 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gccuggaguuuauucggaatt

SEQ ID NO: 1322 - DNA, 21 bp, Artificial sequence
  siRNAs to PCSK9
  5'-terminal nucleic acid is a nucleoside, i.e. base + sugar but lacking 5'-phosphate
  modified_base 2: /mod_base = "2'-O-methyl corresponding base"
  modified_base 21: /mod_base = "5'-thio thymidine"
  modified_base 1, 3, 4, 5, 6, 7, 8, 9, 10, 11, 12, 13, 14, 15, 16, 17, 18, 19: /mod_base = "2'-hydroxy corresponding base"
uuccgaauaaacuccaggctt

SEQ ID NO: 1323 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gccuggaguuuauucggaatt

SEQ ID NO: 1324 - DNA, 21 bp, Artificial sequence
  siRNAs to PCSK9
  5'-terminal nucleic acid is a nucleoside, i.e. base + sugar but lacking 5'-phosphate
  modified_base 3: /mod_base = "2'-O-methyl corresponding base"
  modified_base 21: /mod_base = "5'-thio thymidine"
  modified_base 1, 2, 4, 5, 6, 7, 8, 9, 10, 11, 12, 13, 14, 15, 16, 17, 18, 19: /mod_base = "2'-hydroxy corresponding base"
uuccgaauaaacuccaggctt

SEQ ID NO: 1325 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gccuggaguuuauucggaatt

SEQ ID NO: 1326 - DNA, 21 bp, Artificial sequence
  siRNAs to PCSK9
  5'-terminal nucleic acid is a nucleoside, i.e. base + sugar but lacking 5'-phosphate
  modified_base 4: /mod_base = "2'-O-methyl corresponding base"
  modified_base 21: /mod_base = "5'-thio thymidine"
  modified_base 1, 2, 3, 5, 6, 7, 8, 9, 10, 11, 12, 13, 14, 15, 16, 17, 18, 19: /mod_base = "2'-hydroxy corresponding base"
uuccgaauaaacuccaggctt

SEQ ID NO: 1327 - RNA, 19 nt, Artificial sequence
  siRNAs to PCSK9
  5'-terminal nucleic acid is a nucleoside, i.e. base + sugar but lacking 5'-phosphate
  modified_base 2, 3, 4, 9, 10, 11, 13, 14, 15: /mod_base = "2'-O-methyl corresponding base"
gccuggaguuuauucggaa

SEQ ID NO: 1328 - RNA, 21 nt, Artificial sequence
  siRNAs to PCSK9
  5'-terminal nucleic acid is a nucleoside, i.e. base + sugar but lacking 5'-phosphate
  modified_base 20, 21: /mod_base = "2'-O-methyl corresponding base 5'-monophosphorothioate"
uuccgaauaaacuccaggccu

SEQ ID NO: 1329 - RNA, 20 nt, Artificial sequence
  siRNAs to PCSK9
  5'-terminal nucleic acid is a nucleoside, i.e. base + sugar but lacking 5'-phosphate
  modified_base 2, 3, 4, 9, 10, 11, 13, 14, 15: /mod_base = "2'-O-methyl corresponding base"
gccuggaguuuauucggaaa

SEQ ID NO: 1330 - RNA, 22 nt, Artificial sequence
  siRNAs to PCSK9
  5'-terminal nucleic acid is a nucleoside, i.e. base + sugar but lacking 5'-phosphate
  modified_base 21, 22: /mod_base = "2'-O-methyl corresponding base 5'-monophosphorothioate"
uuuccgaauaaacuccaggccu

SEQ ID NO: 1331 - RNA, 21 nt, Artificial sequence
  siRNAs to PCSK9
  5'-terminal nucleic acid is a nucleoside, i.e. base + sugar but lacking 5'-phosphate
  modified_base 2, 3, 4, 9, 10, 11, 13, 14, 15: /mod_base = "2'-O-methyl corresponding base"
gccuggaguuuauucggaaaa

SEQ ID NO: 1332 - RNA, 23 nt, Artificial sequence
  siRNAs to PCSK9
  5'-terminal nucleic acid is a nucleoside, i.e. base + sugar but lacking 5'-phosphate
  modified_base 22, 23: /mod_base = "2'-O-methyl corresponding base 5'-monophosphorothioate"
uuuuccgaauaaacuccaggccu

SEQ ID NO: 1333 - RNA, 22 nt, Artificial sequence
  siRNAs to PCSK9
  5'-terminal nucleic acid is a nucleoside, i.e. base + sugar but lacking 5'-phosphate
  modified_base 2, 3, 4, 9, 10, 11, 13, 14, 15: /mod_base = "2'-O-methyl corresponding base"
gccuggaguuuauucggaaaag

SEQ ID NO: 1334 - RNA, 24 nt, Artificial sequence
  siRNAs to PCSK9
  5'-terminal nucleic acid is a nucleoside, i.e. base + sugar but lacking 5'-phosphate
  modified_base 23, 24: /mod_base = "2'-O-methyl corresponding base 5'-monophosphorothioate"
cuuuuccgaauaaacuccaggccu

SEQ ID NO: 1335 - DNA, 21 bp, Artificial sequence
  siRNAs to PCSK9
  5'-terminal nucleic acid is a nucleoside, i.e. base + sugar but lacking 5'-phosphate
  modified_base 2, 3, 4, 9, 10, 11, 13, 14, 15: /mod_base = "2'-O-methyl corresponding base"
  modified_base 21: /mod_base = "thymidine with 3'-abasic nucleotide"
  modified_base 1, 5, 6, 7, 8, 12, 16, 17, 18, 19: /mod_base = "2'-hydroxy corresponding base"
gccuggaguuuauucggaatt

SEQ ID NO: 1336 - DNA, 21 bp, Artificial sequence
  siRNAs to PCSK9
  5'-terminal nucleic acid is a nucleoside, i.e. base + sugar but lacking 5'-phosphate
  modified_base 22: /mod_base = "2'-O-methyl corresponding base"
  modified_base 1..19: /mod_base = "2'-hydroxy corresponding base"
uuccgaauaaacuccaggctt

SEQ ID NO: 1337 - DNA, 22 bp, Artificial sequence
  siRNAs to PCSK9
  5'-terminal nucleic acid is a nucleoside, i.e. base + sugar but lacking 5'-phosphate
  modified_base 2, 3, 4, 9, 10, 11, 13, 14, 15: /mod_base = "2'-O-methyl corresponding base"
  modified_base 22: /mod_base = "thymidine with 3'-abasic nucleotide"
  modified_base 1, 5, 6, 7, 8, 12, 16, 17, 18, 19, 20: /mod_base = "2'-hydroxy corresponding base"
gccuggaguuuauucggaaatt

SEQ ID NO: 1338 - DNA, 22 bp, Artificial sequence
  siRNAs to PCSK9
  5'-terminal nucleic acid is a nucleoside, i.e. base + sugar but lacking 5'-phosphate
  modified_base 9, 23: /mod_base = "2'-O-methyl corresponding base"
  modified_base 1, 2, 3, 4, 5, 6, 7, 8, 10, 11, 12, 13, 14, 15, 16, 17, 18, 19, 20: /mod_base = "2'-hydroxy corresponding base"
uuuccgaauaaacuccaggctt

SEQ ID NO: 1339 - DNA, 23 bp, Artificial sequence
  siRNAs to PCSK9
  5'-terminal nucleic acid is a nucleoside, i.e. base + sugar but lacking 5'-phosphate
  modified_base 2, 3, 4, 9, 10, 11, 13, 14, 15: /mod_base = "2'-O-methyl corresponding base"
  modified_base 23: /mod_base = "thymidine with 3'-abasic nucleotide"
  modified_base 1, 5, 6, 7, 8, 12, 16, 17, 18, 19, 20, 21: /mod_base = "2'-hydroxy corresponding base"
gccuggaguuuauucggaaaatt

SEQ ID NO: 1340 - DNA, 23 bp, Artificial sequence
  siRNAs to PCSK9
  5'-terminal nucleic acid is a nucleoside, i.e. base + sugar but lacking 5'-phosphate
  modified_base 24: /mod_base = "2'-O-methyl corresponding base"
  modified_base 1..21: /mod_base = "2'-hydroxy corresponding base"
uuuuccgaauaaacuccaggctt

SEQ ID NO: 1341 - DNA, 24 bp, Artificial sequence
  siRNAs to PCSK9
  5'-terminal nucleic acid is a nucleoside, i.e. base + sugar but lacking 5'-phosphate
  modified_base 2, 3, 4, 9, 10, 11, 13, 14, 15: /mod_base = "2'-O-methyl corresponding base"
  modified_base 24: /mod_base = "thymidine with 3'-abasic nucleotide"
  modified_base 1, 5, 6, 7, 8, 12, 16, 17, 18, 19, 20, 21, 22: /mod_base = "2'-hydroxy corresponding base"
gccuggaguuuauucggaaaagtt

SEQ ID NO: 1342 - DNA, 24 bp, Artificial sequence
  siRNAs to PCSK9
  5'-terminal nucleic acid is a nucleoside, i.e. base + sugar but lacking 5'-phosphate
  modified_base 25: /mod_base = "2'-O-methyl corresponding base"
  modified_base 1..22: /mod_base = "2'-hydroxy corresponding base"
cuuuuccgaauaaacuccaggctt

SEQ ID NO: 1343 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
gccuggaguuuauucggaatt

SEQ ID NO: 1344 - RNA, 21 nt, Artificial sequence
  siRNAs to PCSK9
  5'-terminal nucleic acid is a nucleoside, i.e. base + sugar but lacking 5'-phosphate
  modified_base 20, 21: /mod_base = "2'-O-methyl corresponding base 5'-monophosphorothioate"
uuccgaauaaacuccaggccu

SEQ ID NO: 1345 - DNA, 21 bp, Artificial sequence
  siRNAs to PCSK9
  5'-terminal nucleic acid is a nucleoside, i.e. base + sugar but lacking 5'-phosphate
  modified_base 2, 3, 4, 9, 10, 11, 13, 14, 15: /mod_base = "2'-O-methyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1346 - RNA, 21 nt, Artificial sequence
  siRNAs to PCSK9
  5'-terminal nucleic acid is a nucleoside, i.e. base + sugar but lacking 5'-phosphate
  modified_base 20, 21: /mod_base = "2'-O-methyl corresponding base 5'-monophosphorothioate"
uuccgaauaaacuccaggccu

SEQ ID NO: 1347 - RNA, 19 nt, Artificial sequence
  siRNAs to PCSK9
  5'-terminal nucleic acid is a nucleoside, i.e. base + sugar but lacking 5'-phosphate
  modified_base 2, 4, 6, 8, 10, 12, 14, 16, 18: /mod_base = "2'-O-methyl corresponding base"
gccuggaguuuauucggaa

SEQ ID NO: 1348 - DNA, 21 bp, Artificial sequence
  siRNAs to PCSK9
  5'-terminal nucleic acid is a nucleoside, i.e. base + sugar but lacking 5'-phosphate
  modified_base 22: /mod_base = "2'-O-methyl corresponding base"
  modified_base 1..19: /mod_base = "2'-hydroxy corresponding base"
uuccgaauaaacuccaggctt

SEQ ID NO: 1349 - RNA, 19 nt, Artificial sequence
  siRNAs to PCSK9
  5'-terminal nucleic acid is a nucleoside, i.e. base + sugar but lacking 5'-phosphate
  modified_base 2, 4, 6, 8, 10, 12, 14, 16, 18: /mod_base = "2'-O-methyl corresponding base"
gccuggaguuuauucggaa

SEQ ID NO: 1350 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
uuccgaauaaacuccaggctt

SEQ ID NO: 1351 - RNA, 19 nt, Artificial sequence
  siRNAs to PCSK9
  5'-terminal nucleic acid is a nucleoside, i.e. base + sugar but lacking 5'-phosphate
  modified_base 2, 4, 6, 8, 10, 12, 14, 16, 18: /mod_base = "2'-O-methyl corresponding base"
gccuggaguuuauucggaa

SEQ ID NO: 1352 - DNA, 21 bp, Artificial sequence
  siRNAs to PCSK9
  5'-terminal nucleic acid is a nucleoside, i.e. base + sugar but lacking 5'-phosphate
  modified_base 8, 15: /mod_base = "2'-O-methyl corresponding base"
  modified_base 21: /mod_base = "5'-thio thymidine"
  modified_base 1, 2, 3, 4, 5, 6, 7, 9, 10, 11, 12, 13, 14, 16, 17, 18, 19: /mod_base = "2'-hydroxy corresponding base"
uuccgaauaaacuccaggctt

SEQ ID NO: 1353 - RNA, 19 nt, Artificial sequence
  siRNAs to PCSK9
  5'-terminal nucleic acid is a nucleoside, i.e. base + sugar but lacking 5'-phosphate
  modified_base 2, 4, 6, 8, 10, 12, 14, 16, 18: /mod_base = "2'-O-methyl corresponding base"
gccuggaguuuauucggaa

SEQ ID NO: 1354 - DNA, 21 bp, Artificial sequence
  siRNAs to PCSK9
  5'-terminal nucleic acid is a nucleoside, i.e. base + sugar but lacking 5'-phosphate
  modified_base 1, 3, 8, 14, 15: /mod_base = "2'-O-methyl corresponding base"
  modified_base 21: /mod_base = "5'-thio thymidine"
  modified_base 2, 4, 5, 6, 7, 9, 10, 11, 12, 13, 16, 17, 18, 19: /mod_base = "2'-hydroxy corresponding base"
uuccgaauaaacuccaggctt

SEQ ID NO: 1355 - RNA, 19 nt, Artificial sequence
  siRNAs to PCSK9
  5'-terminal nucleic acid is a nucleoside, i.e. base + sugar but lacking 5'-phosphate
  modified_base 2, 4, 6, 8, 10, 12, 14, 16, 18: /mod_base = "2'-O-methyl corresponding base"
gccuggaguuuauucggaa

SEQ ID NO: 1356 - RNA, 19 nt, Artificial sequence
  siRNAs to PCSK9
  5'-terminal nucleic acid is a nucleoside, i.e. base + sugar but lacking 5'-phosphate
  modified_base 6, 7, 10, 11, 17, 18, 19: /mod_base = "2'-O-methyl corresponding base"
uuccgaauaaacuccaggc

SEQ ID NO: 1357 - DNA, 21 bp, Artificial sequence
  siRNAs to PCSK9
  5'-terminal nucleic acid is a nucleoside, i.e. base + sugar but lacking 5'-phosphate
  modified_base 2, 4, 6, 9, 11, 13, 15, 17, 19: /mod_base = "2'-O-methyl corresponding base"
  modified_base 22: /mod_base = "5'-thio thymidine"
  modified_base 1, 3, 5, 8, 10, 12, 14, 16, 18, 20: /mod_base = "2'-hydroxy corresponding base"
gccuggaguuuauucggaatt

SEQ ID NO: 1358 - DNA, 21 bp, Artificial sequence
  siRNAs to PCSK9
  5'-terminal nucleic acid is a nucleoside, i.e. base + sugar but lacking 5'-phosphate
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
uuccgaauaaacuccaggctt

SEQ ID NO: 1359 - DNA, 21 bp, Artificial sequence
  siRNAs to PCSK9
  5'-terminal nucleic acid is a nucleoside, i.e. base + sugar but lacking 5'-phosphate
  modified_base 2, 4, 6, 8, 10, 12, 14, 16, 18: /mod_base = "2'-O-methyl corresponding base"
  modified_base 21: /mod_base = "thymidine with 3'-abasic nucleotide"
  modified_base 1, 3, 5, 7, 9, 11, 13, 15, 17, 19: /mod_base = "2'-hydroxy corresponding base"
gccuggaguuuauucggaatt

SEQ ID NO: 1360 - DNA, 21 bp, Artificial sequence
  siRNAs to PCSK9
  5'-terminal nucleic acid is a nucleoside, i.e. base + sugar but lacking 5'-phosphate
  modified_base 6, 7, 10, 11, 17, 18, 19, 22: /mod_base = "2'-O-methyl corresponding base"
  modified_base 1, 2, 3, 4, 5, 8, 9, 12, 13, 14, 15, 16: /mod_base = "2'-hydroxy corresponding base"
uuccgaauaaacuccaggctt

SEQ ID NO: 1361 - RNA, 19 nt, Artificial sequence
  siRNAs to PCSK9
  5'-terminal nucleic acid is a nucleoside, i.e. base + sugar but lacking 5'-phosphate
  modified_base 2, 4, 6, 8, 10, 12, 14, 16, 18: /mod_base = "2'-O-methyl corresponding base"
gccuggaguuuauucggaa

SEQ ID NO: 1362 - RNA, 21 nt, Artificial sequence
  siRNAs to PCSK9
  5'-terminal nucleic acid is a nucleoside, i.e. base + sugar but lacking 5'-phosphate
  modified_base 6, 7, 10, 11, 17, 18, 19: /mod_base = "2'-O-methyl corresponding base"
  modified_base 20, 21: /mod_base = "2'-O-methyl corresponding base 5'-monophosphorothioate"
uuccgaauaaacuccaggccu

SEQ ID NO: 1363 - DNA, 21 bp, Artificial sequence
  siRNAs to PCSK9
  5'-terminal nucleic acid is a nucleoside, i.e. base + sugar but lacking 5'-phosphate
  modified_base 2, 4, 6, 9, 11, 13, 15, 17, 19: /mod_base = "2'-O-methyl corresponding base"
  modified_base 22: /mod_base = "5'-thio thymidine"
  modified_base 1, 3, 5, 8, 10, 12, 14, 16, 18, 20: /mod_base = "2'-hydroxy corresponding base"
gccuggaguuuauucggaatt

SEQ ID NO: 1364 - DNA, 21 bp, Artificial sequence
  siRNAs to PCSK9
  5'-terminal nucleic acid is a nucleoside, i.e. base + sugar but lacking 5'-phosphate
  modified_base 8, 15: /mod_base = "2'-O-methyl corresponding base"
  modified_base 21: /mod_base = "5'-thio thymidine"
  modified_base 1, 2, 3, 4, 5, 6, 7, 9, 10, 11, 12, 13, 14, 16, 17, 18, 19: /mod_base = "2'-hydroxy corresponding base"
uuccgaauaaacuccaggctt

SEQ ID NO: 1365 - DNA, 21 bp, Artificial sequence
  siRNAs to PCSK9
  5'-terminal nucleic acid is a nucleoside, i.e. base + sugar but lacking 5'-phosphate
  modified_base 2, 4, 6, 8, 10, 12, 14, 16, 18: /mod_base = "2'-O-methyl corresponding base"
  modified_base 21: /mod_base = "thymidine with 3'-abasic nucleotide"
  modified_base 1, 3, 5, 7, 9, 11, 13, 15, 17, 19: /mod_base = "2'-hydroxy corresponding base"
gccuggaguuuauucggaatt

SEQ ID NO: 1366 - DNA, 21 bp, Artificial sequence
  siRNAs to PCSK9
  5'-terminal nucleic acid is a nucleoside, i.e. base + sugar but lacking 5'-phosphate
  modified_base 8, 15, 22: /mod_base = "2'-O-methyl corresponding base"
  modified_base 1, 2, 3, 4, 5, 6, 7, 9, 10, 11, 12, 13, 14, 16, 17, 18, 19: /mod_base = "2'-hydroxy corresponding base"
uuccgaauaaacuccaggctt

SEQ ID NO: 1367 - RNA, 19 nt, Artificial sequence
  siRNAs to PCSK9
  5'-terminal nucleic acid is a nucleoside, i.e. base + sugar but lacking 5'-phosphate
  modified_base 2, 4, 6, 8, 10, 12, 14, 16, 18: /mod_base = "2'-O-methyl corresponding base"
gccuggaguuuauucggaa

SEQ ID NO: 1368 - RNA, 21 nt, Artificial sequence
  siRNAs to PCSK9
  5'-terminal nucleic acid is a nucleoside, i.e. base + sugar but lacking 5'-phosphate
  modified_base 8, 15: /mod_base = "2'-O-methyl corresponding base"
  modified_base 20, 21: /mod_base = "2'-O-methyl corresponding base 5'-monophosphorothioate"
uuccgaauaaacuccaggccu

SEQ ID NO: 1369 - DNA, 21 bp, Artificial sequence
  siRNAs to PCSK9
  5'-terminal nucleic acid is a nucleoside, i.e. base + sugar but lacking 5'-phosphate
  modified_base 2, 4, 6, 9, 11, 13, 15, 17, 19: /mod_base = "2'-O-methyl corresponding base"
  modified_base 22: /mod_base = "5'-thio thymidine"
  modified_base 1, 3, 5, 8, 10, 12, 14, 16, 18, 20: /mod_base = "2'-hydroxy corresponding base"
gccuggaguuuauucggaatt

SEQ ID NO: 1370 - DNA, 21 bp, Artificial sequence
  siRNAs to PCSK9
  5'-terminal nucleic acid is a nucleoside, i.e. base + sugar but lacking 5'-phosphate
  modified_base 21: /mod_base = "5'-thio thymidine"
  modified_base 1..19: /mod_base = "2'-hydroxy corresponding base"
uuccgaauaaacuccaggctt

SEQ ID NO: 1371 - DNA, 21 bp, Artificial sequence
  siRNAs to PCSK9
  5'-terminal nucleic acid is a nucleoside, i.e. base + sugar but lacking 5'-phosphate
  modified_base 2, 4, 6, 8, 10, 12, 14, 16, 18: /mod_base = "2'-O-methyl corresponding base"
  modified_base 21: /mod_base = "thymidine with 3'-abasic nucleotide"
  modified_base 1, 3, 5, 7, 9, 11, 13, 15, 17, 19: /mod_base = "2'-hydroxy corresponding base"
gccuggaguuuauucggaatt

SEQ ID NO: 1372 - DNA, 21 bp, Artificial sequence
  siRNAs to PCSK9
  5'-terminal nucleic acid is a nucleoside, i.e. base + sugar but lacking 5'-phosphate
  modified_base 22: /mod_base = "2'-O-methyl corresponding base"
  modified_base 1..19: /mod_base = "2'-hydroxy corresponding base"
uuccgaauaaacuccaggctt

SEQ ID NO: 1373 - RNA, 19 nt, Artificial sequence
  siRNAs to PCSK9
  5'-terminal nucleic acid is a nucleoside, i.e. base + sugar but lacking 5'-phosphate
  modified_base 2, 4, 6, 8, 10, 12, 14, 16, 18: /mod_base = "2'-O-methyl corresponding base"
gccuggaguuuauucggaa

SEQ ID NO: 1374 - RNA, 21 nt, Artificial sequence
  siRNAs to PCSK9
  5'-terminal nucleic acid is a nucleoside, i.e. base + sugar but lacking 5'-phosphate
  modified_base 20, 21: /mod_base = "2'-O-methyl corresponding base 5'-monophosphorothioate"
uuccgaauaaacuccaggccu

SEQ ID NO: 1375 - RNA, 19 nt, Artificial sequence
  siRNAs to PCSK9
  5'-terminal nucleic acid is a nucleoside, i.e. base + sugar but lacking 5'-phosphate
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
gccuggaguuuauucggaa

SEQ ID NO: 1376 - RNA, 19 nt, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
uuccgaauaaacuccaggc

SEQ ID NO: 1377 - RNA, 19 nt, Artificial sequence
  siRNAs to PCSK9
  modified_base 2, 4, 6, 8, 10, 12, 14, 16, 18: /mod_base = "2'-O-methyl corresponding base"
gccuggaguuuauucggaa

SEQ ID NO: 1378 - RNA, 19 nt, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
uuccgaauaaacuccaggc

SEQ ID NO: 1379 - RNA, 19 nt, Artificial sequence
  siRNAs to PCSK9
  modified_base 2, 3, 4, 9, 10, 11, 13, 14, 15: /mod_base = "2'-O-methyl corresponding base"
gccuggaguuuauucggaa

SEQ ID NO: 1380 - RNA, 19 nt, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
uuccgaauaaacuccaggc

SEQ ID NO: 1381 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
gccuggaguuuauucggaatt

SEQ ID NO: 1382 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
uuccgaauaaacuccaggctt

SEQ ID NO: 1383 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
gccuggaguuuauucggaatt

SEQ ID NO: 1384 - DNA, 21 bp, Artificial sequence
  siRNAs to PCSK9
  modified_base 8, 15: /mod_base = "2'-O-methyl corresponding base"
  modified_base 21: /mod_base = "5'-thio thymidine"
  modified_base 1, 2, 3, 4, 5, 6, 7, 9, 10, 11, 12, 13, 14, 16, 17, 18, 19: /mod_base = "2'-hydroxy corresponding base"
uuccgaauaaacuccaggctt

SEQ ID NO: 1385 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
gccuggaguuuauucggaatt

SEQ ID NO: 1386 - DNA, 21 bp, Artificial sequence
  siRNAs to PCSK9
  modified_base 1, 3, 8, 14, 15: /mod_base = "2'-O-methyl corresponding base"
  modified_base 21: /mod_base = "5'-thio thymidine"
  modified_base 2, 4, 5, 6, 7, 9, 10, 11, 12, 13, 16, 17, 18, 19: /mod_base = "2'-hydroxy corresponding base"
uuccgaauaaacuccaggctt

SEQ ID NO: 1387 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
gccuggaguuuauucggaatt

SEQ ID NO: 1388 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uuccgaauaaacuccaggctt

SEQ ID NO: 1389 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
gccuggaguuuauucggaatt

SEQ ID NO: 1390 - RNA, 21 nt, Artificial sequence
  siRNAs to PCSK9
  modified_base 20, 21: /mod_base = "2'-O-methyl corresponding base 5'-monophosphorothioate"
uuccgaauaaacuccaggccu

SEQ ID NO: 1391 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
gccuggaguuuauucggaatt

SEQ ID NO: 1392 - RNA, 21 nt, Artificial sequence
  siRNAs to PCSK9
  modified_base 6, 7, 10, 11, 17, 18, 19: /mod_base = "2'-O-methyl corresponding base"
  modified_base 20, 21: /mod_base = "2'-O-methyl corresponding base 5'-monophosphorothioate"
uuccgaauaaacuccaggccu

SEQ ID NO: 1393 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gccuggaguuuauucggaatt

SEQ ID NO: 1394 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
uuccgaauaaacuccaggctt

SEQ ID NO: 1395 - DNA, 21 bp, Artificial sequence
  siRNAs to PCSK9
  modified_base 2, 3, 4, 9, 10, 11, 13, 14, 15: /mod_base = "2'-O-methyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1396 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
uuccgaauaaacuccaggctt

SEQ ID NO: 1397 - DNA, 21 bp, Artificial sequence
  siRNAs to PCSK9
  modified_base 2, 4, 6, 9, 11, 13, 15, 17, 19: /mod_base = "2'-O-methyl corresponding base"
  modified_base 22: /mod_base = "5'-thio thymidine"
  modified_base 1, 3, 5, 8, 10, 12, 14, 16, 18, 20: /mod_base = "2'-hydroxy corresponding base"
gccuggaguuuauucggaatt

SEQ ID NO: 1398 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
uuccgaauaaacuccaggctt

SEQ ID NO: 1399 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "thymidine with 3'-abasic nucleotide"
gccuggaguuuauucggaatt

SEQ ID NO: 1400 - DNA, 21 bp, Artificial sequence
  siRNAs to PCSK9
  modified_base 1, 3, 5, 7, 9, 11, 13, 15, 17, 19, 22: /mod_base = "2'-O-methyl corresponding base"
  modified_base 2, 4, 6, 8, 10, 12, 14, 16, 18: /mod_base = "2'-deoxy-2'-fluoro corresponding base"
uuccgaauaaacuccaggctt

SEQ ID NO: 1401 - RNA, 19 nt, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
gccuggaguuuauucggaa

SEQ ID NO: 1402 - RNA, 21 nt, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "2'-O-methyl corresponding base 5'-monophosphorothioate"
  modified_base 20: /mod_base = "2'-deoxy-2'-fluoro corresponding base 5'-monophosphorothioate"
uuccgaauaaacuccaggccu

SEQ ID NO: 1403 - RNA, 19 nt, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
gccuggaguuuauucggaa

SEQ ID NO: 1404 - RNA, 21 nt, Artificial sequence
  siRNAs to PCSK9
  modified_base 6, 7, 10, 11, 17, 18, 19: /mod_base = "2'-O-methyl corresponding base"
  modified_base 20, 21: /mod_base = "2'-O-methyl corresponding base 5'-monophosphorothioate"
uuccgaauaaacuccaggccu

SEQ ID NO: 1405 - RNA, 19 nt, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
gccuggaguuuauucggaa

SEQ ID NO: 1406 - RNA, 21 nt, Artificial sequence
  siRNAs to PCSK9
  modified_base 20, 21: /mod_base = "2'-O-methyl corresponding base 5'-monophosphorothioate"
uuccgaauaaacuccaggccu

SEQ ID NO: 1407 - RNA, 19 nt, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
gccuggaguuuauucggaa

SEQ ID NO: 1408 - DNA, 21 bp, Artificial sequence
  siRNAs to PCSK9
  modified_base 8, 15: /mod_base = "2'-O-methyl corresponding base"
  modified_base 21: /mod_base = "5'-thio thymidine"
  modified_base 1, 2, 3, 4, 5, 6, 7, 9, 10, 11, 12, 13, 14, 16, 17, 18, 19: /mod_base = "2'-hydroxy corresponding base"
uuccgaauaaacuccaggctt

SEQ ID NO: 1409 - RNA, 19 nt, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
gccuggaguuuauucggaa

SEQ ID NO: 1410 - DNA, 21 bp, Artificial sequence
  siRNAs to PCSK9
  modified_base 1, 3, 8, 14, 15: /mod_base = "2'-O-methyl corresponding base"
  modified_base 21: /mod_base = "5'-thio thymidine"
  modified_base 2, 4, 5, 6, 7, 9, 10, 11, 12, 13, 16, 17, 18, 19: /mod_base = "2'-hydroxy corresponding base"
uuccgaauaaacuccaggctt

SEQ ID NO: 1411 - RNA, 19 nt, Artificial sequence
  siRNAs to PCSK9
  modified_base 2, 4, 6, 8, 10, 12, 14, 16, 18: /mod_base = "2'-O-methoxyethyl corresponding base"
gccuggaguuuauucggaa

SEQ ID NO: 1412 - RNA, 19 nt, Artificial sequence
  siRNAs to PCSK9
  modified_base 6, 7, 10, 11, 17, 18, 19: /mod_base = "2'-O-methyl corresponding base"
uuccgaauaaacuccaggc

SEQ ID NO: 1413 - RNA, 19 nt, Artificial sequence
  siRNAs to PCSK9
  modified_base 2, 4, 6, 8, 10, 12, 14, 16, 18: /mod_base = "2'-O-methoxyethyl corresponding base"
gccuggaguuuauucggaa

SEQ ID NO: 1414 - RNA, 19 nt, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
uuccgaauaaacuccaggc

SEQ ID NO: 1415 - RNA, 19 nt, Artificial sequence
  siRNAs to PCSK9
  modified_base 2, 4, 6, 8, 10, 12, 14, 16, 18: /mod_base = "2'-O-methoxyethyl corresponding base"
gccuggaguuuauucggaa

SEQ ID NO: 1416 - RNA, 21 nt, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 20: /mod_base = "2'-deoxy-2'-fluoro corresponding base 5'-monophosphorothioate"
  modified_base 21: /mod_base = "2'-O-methyl corresponding base 5'-monophosphorothioate"
uuccgaauaaacuccaggccu

SEQ ID NO: 1417 - RNA, 19 nt, Artificial sequence
  siRNAs to PCSK9
  modified_base 2, 4, 6, 8, 10, 12, 14, 16, 18: /mod_base = "2'-O-methoxyethyl corresponding base"
gccuggaguuuauucggaa

SEQ ID NO: 1418 - RNA, 21 nt, Artificial sequence
  siRNAs to PCSK9
  modified_base 20, 21: /mod_base = "2'-O-methyl corresponding base 5'-monophosphorothioate"
uuccgaauaaacuccaggccu

SEQ ID NO: 1419 - RNA, 19 nt, Artificial sequence
  siRNAs to PCSK9
  modified_base 2, 4, 6, 8, 10, 12, 14, 16, 18: /mod_base = "2'-O-methoxyethyl corresponding base"
gccuggaguuuauucggaa

SEQ ID NO: 1420 - DNA, 21 bp, Artificial sequence
  siRNAs to PCSK9
  modified_base 8, 15: /mod_base = "2'-O-methyl corresponding base"
  modified_base 21: /mod_base = "5'-thio thymidine"
  modified_base 1, 2, 3, 4, 5, 6, 7, 9, 10, 11, 12, 13, 14, 16, 17, 18, 19: /mod_base = "2'-hydroxy corresponding base"
uuccgaauaaacuccaggctt

SEQ ID NO: 1421 - RNA, 19 nt, Artificial sequence
  siRNAs to PCSK9
  modified_base 2, 4, 6, 8, 10, 12, 14, 16, 18: /mod_base = "2'-O-methoxyethyl corresponding base"
gccuggaguuuauucggaa

SEQ ID NO: 1422 - DNA, 21 bp, Artificial sequence
  siRNAs to PCSK9
  modified_base 1, 3, 8, 14, 15: /mod_base = "2'-O-methyl corresponding base"
  modified_base 21: /mod_base = "5'-thio thymidine"
  modified_base 2, 4, 5, 6, 7, 9, 10, 11, 12, 13, 16, 17, 18, 19: /mod_base = "2'-hydroxy corresponding base"
uuccgaauaaacuccaggctt

SEQ ID NO: 1423 - RNA, 19 nt, Artificial sequence
  siRNAs to PCSK9
  modified_base 2, 4, 6, 8, 10, 12, 14, 16, 18: /mod_base = "2'-O-methoxyethyl corresponding base"
gccuggaguuuauucggaa

SEQ ID NO: 1424 - RNA, 21 nt, Artificial sequence
  siRNAs to PCSK9
  modified_base 6, 7, 10, 11, 17, 18, 19: /mod_base = "2'-O-methyl corresponding base"
  modified_base 20, 21: /mod_base = "2'-O-methyl corresponding base 5'-monophosphorothioate"
uuccgaauaaacuccaggccu

SEQ ID NO: 1425 - DNA, 21 bp, Artificial sequence
  siRNAs to PCSK9
  modified_base 2, 4, 6, 8, 10, 12, 14, 16, 18: /mod_base = "2'-O-methoxyethyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
gccuggaguuuauucggaatt

SEQ ID NO: 1426 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
uuccgaauaaacuccaggctt

SEQ ID NO: 1427 - DNA, 21 bp, Artificial sequence
  siRNAs to PCSK9
  modified_base 2, 4, 6, 8, 10, 12, 14, 16, 18: /mod_base = "2'-O-methoxyethyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
gccuggaguuuauucggaatt

SEQ ID NO: 1428 - DNA, 21 bp, Artificial sequence
  siRNAs to PCSK9
  modified_base 8, 15: /mod_base = "2'-O-methyl corresponding base"
  modified_base 21: /mod_base = "5'-thio thymidine"
  modified_base 1, 2, 3, 4, 5, 6, 7, 9, 10, 11, 12, 13, 14, 16, 17, 18, 19: /mod_base = "2'-hydroxy corresponding base"
uuccgaauaaacuccaggctt

SEQ ID NO: 1429 - DNA, 21 bp, Artificial sequence
  siRNAs to PCSK9
  modified_base 2, 4, 6, 8, 10, 12, 14, 16, 18: /mod_base = "2'-O-methoxyethyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
gccuggaguuuauucggaatt

SEQ ID NO: 1430 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uuccgaauaaacuccaggctt

SEQ ID NO: 1431 - DNA, 21 bp, Artificial sequence
  siRNAs to PCSK9
  modified_base 2, 3, 4, 9, 10, 11, 13, 14, 15: /mod_base = "2'-O-methoxyethyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1432 - DNA, 21 bp, Artificial sequence
  siRNAs to PCSK9
  modified_base 6, 7, 10, 11, 17, 18, 19: /mod_base = "2'-O-methyl corresponding base"
  modified_base 21: /mod_base = "5'-thio thymidine"
  modified_base 1, 2, 3, 4, 5, 8, 9, 12, 13, 14, 15, 16: /mod_base = "2'-hydroxy corresponding base"
uuccgaauaaacuccaggctt

SEQ ID NO: 1433 - DNA, 21 bp, Artificial sequence
  siRNAs to PCSK9
  modified_base 2, 3, 4, 9, 10, 11, 13, 14, 15: /mod_base = "2'-O-methoxyethyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1434 - DNA, 21 bp, Artificial sequence
  siRNAs to PCSK9
  modified_base 8, 15: /mod_base = "2'-O-methyl corresponding base"
  modified_base 21: /mod_base = "5'-thio thymidine"
  modified_base 1, 2, 3, 4, 5, 6, 7, 9, 10, 11, 12, 13, 14, 16, 17, 18, 19: /mod_base = "2'-hydroxy corresponding base"
uuccgaauaaacuccaggctt

SEQ ID NO: 1435 - DNA, 21 bp, Artificial sequence
  siRNAs to PCSK9
  modified_base 2, 3, 4, 9, 10, 11, 13, 14, 15: /mod_base = "2'-O-methoxyethyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1436 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uuccgaauaaacuccaggctt

SEQ ID NO: 1437 - DNA, 21 bp, Artificial sequence
  siRNAs to PCSK9
  modified_base 2, 3, 4, 9, 10, 11, 13, 14, 15: /mod_base = "2'-O-methoxyethyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1438 - DNA, 21 bp, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 21: /mod_base = "5'-thio thymidine"
  modified_base 5, 6, 7, 9, 10, 11, 16, 17, 18: /mod_base = "2'-hydroxy corresponding base"
uuccgaauaaacuccaggctt

SEQ ID NO: 1439 - DNA, 21 bp, Artificial sequence
  siRNAs to PCSK9
  modified_base 2, 3, 4, 9, 10, 11, 13, 14, 15: /mod_base = "2'-O-methoxyethyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1440 - RNA, 21 nt, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 20, 21: /mod_base = "2'-deoxy-2'-fluoro corresponding base 5'-monophosphorothioate"
uuccgaauaaacuccaggccu

SEQ ID NO: 1441 - DNA, 21 bp, Artificial sequence
  siRNAs to PCSK9
  modified_base 2, 3, 4, 9, 10, 11, 13, 14, 15: /mod_base = "2'-O-methoxyethyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1442 - RNA, 21 nt, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "2'-O-methyl corresponding base 5'-monophosphorothioate"
  modified_base 20: /mod_base = "2'-deoxy-2'-fluoro corresponding base 5'-monophosphorothioate"
uuccgaauaaacuccaggccu

SEQ ID NO: 1443 - DNA, 21 bp, Artificial sequence
  siRNAs to PCSK9
  modified_base 2, 3, 4, 9, 10, 11, 13, 14, 15: /mod_base = "2'-O-methoxyethyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1444 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uuccgaauaaacuccaggctt

SEQ ID NO: 1445 - DNA, 21 bp, Artificial sequence
  siRNAs to PCSK9
  modified_base 2, 3, 4, 9, 10, 11, 13, 14, 15: /mod_base = "2'-deoxy-2'-fluoro corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1446 - DNA, 21 bp, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 21: /mod_base = "5'-thio thymidine"
  modified_base 5, 6, 7, 9, 10, 11, 16, 17, 18: /mod_base = "2'-hydroxy corresponding base"
uuccgaauaaacuccaggctt

SEQ ID NO: 1447 - DNA, 21 bp, Artificial sequence
  siRNAs to PCSK9
  modified_base 2, 3, 4, 9, 10, 11, 13, 14, 15: /mod_base = "2'-deoxy-2'-fluoro corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1448 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uuccgaauaaacuccaggctt

SEQ ID NO: 1449 - DNA, 21 bp, Artificial sequence
  siRNAs to PCSK9
  modified_base 2, 3, 4, 9, 10, 11, 13, 14, 15: /mod_base = "2'-deoxy-2'-fluoro corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1450 - DNA, 21 bp, Artificial sequence
  siRNAs to PCSK9
  modified_base 1, 3, 8, 14, 15: /mod_base = "2'-O-methyl corresponding base"
  modified_base 21: /mod_base = "5'-thio thymidine"
  modified_base 2, 4, 5, 6, 7, 9, 10, 11, 12, 13, 16, 17, 18, 19: /mod_base = "2'-hydroxy corresponding base"
uuccgaauaaacuccaggctt

SEQ ID NO: 1451 - DNA, 21 bp, Artificial sequence
  siRNAs to PCSK9
  modified_base 2, 3, 4, 9, 10, 11, 13, 14, 15: /mod_base = "2'-deoxy-2'-fluoro corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1452 - RNA, 21 nt, Artificial sequence
  siRNAs to PCSK9
  modified_base 6, 7, 10, 11, 17, 18, 19: /mod_base = "2'-O-methyl corresponding base"
  modified_base 20, 21: /mod_base = "2'-O-methyl corresponding base 5'-monophosphorothioate"
uuccgaauaaacuccaggccu

SEQ ID NO: 1453 - DNA, 21 bp, Artificial sequence
  siRNAs to PCSK9
  modified_base 2, 3, 4, 9, 10, 11, 13, 14, 15: /mod_base = "2'-deoxy-2'-fluoro corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1454 - RNA, 21 nt, Artificial sequence
  siRNAs to PCSK9
  modified_base 20, 21: /mod_base = "2'-O-methyl corresponding base 5'-monophosphorothioate"
uuccgaauaaacuccaggccu

SEQ ID NO: 1455 - DNA, 21 bp, Artificial sequence
  siRNAs to PCSK9
  modified_base 2, 3, 4, 9, 10, 11, 13, 14, 15: /mod_base = "2'-deoxy-2'-fluoro corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1456 - RNA, 21 nt, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "2'-O-methyl corresponding base 5'-monophosphorothioate"
  modified_base 20: /mod_base = "2'-deoxy-2'-fluoro corresponding base 5'-monophosphorothioate"
uuccgaauaaacuccaggccu

SEQ ID NO: 1457 - DNA, 21 bp, Artificial sequence
  siRNAs to PCSK9
  modified_base 2, 3, 4, 9, 10, 11, 13, 14, 15: /mod_base = "2'-deoxy-2'-fluoro corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1458 - DNA, 21 bp, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "5'-thio thymidine"
uuccgaauaaacuccaggctt

SEQ ID NO: 1459 - DNA, 21 bp, Artificial sequence
  siRNAs to PCSK9
  modified_base 2, 3, 4, 9, 10, 11, 13, 14, 15: /mod_base = "2'-deoxy-2'-fluoro corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1460 - DNA, 21 bp, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 21: /mod_base = "5'-thio thymidine"
  modified_base 5, 6, 7, 9, 10, 11, 16, 17, 18: /mod_base = "2'-hydroxy corresponding base"
uuccgaauaaacuccaggctt

SEQ ID NO: 1461 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gccuggaguuuauucggaatt

SEQ ID NO: 1462 - DNA, 21 bp, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 21: /mod_base = "5'-thio thymidine"
  modified_base 5, 6, 7, 9, 10, 11, 16, 17, 18: /mod_base = "2'-hydroxy corresponding base"
uuccgaauaaacuccaggctt

SEQ ID NO: 1463 - DNA, 21 bp, Artificial sequence
  siRNAs to PCSK9
  modified_base 2, 3, 4, 9, 10, 11, 13, 14, 15: /mod_base = "2'-O-methyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1464 - DNA, 21 bp, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 21: /mod_base = "5'-thio thymidine"
  modified_base 5, 6, 7, 9, 10, 11, 16, 17, 18: /mod_base = "2'-hydroxy corresponding base"
uuccgaauaaacuccaggctt

SEQ ID NO: 1465 - DNA, 21 bp, Artificial sequence
  siRNAs to PCSK9
  modified_base 2, 4, 6, 9, 11, 13, 15, 17, 19: /mod_base = "2'-O-methyl corresponding base"
  modified_base 22: /mod_base = "5'-thio thymidine"
  modified_base 1, 3, 5, 8, 10, 12, 14, 16, 18, 20: /mod_base = "2'-hydroxy corresponding base"
gccuggaguuuauucggaatt

SEQ ID NO: 1466 - DNA, 21 bp, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 21: /mod_base = "5'-thio thymidine"
  modified_base 5, 6, 7, 9, 10, 11, 16, 17, 18: /mod_base = "2'-hydroxy corresponding base"
uuccgaauaaacuccaggctt

SEQ ID NO: 1467 - RNA, 19 nt, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
gccuggaguuuauucggaa

SEQ ID NO: 1468 - DNA, 21 bp, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 21: /mod_base = "5'-thio thymidine"
  modified_base 5, 6, 7, 9, 10, 11, 16, 17, 18: /mod_base = "2'-hydroxy corresponding base"
uuccgaauaaacuccaggctt

SEQ ID NO: 1469 - RNA, 20 nt, Artificial sequence
  siRNAs to PCSK9
  modified_base 2, 3, 4, 10, 11, 12, 14, 15, 16: /mod_base = "2'-deoxy-2'-fluoro corresponding base"
gccuggagguuuauucggaa

SEQ ID NO: 1470 - RNA, 21 nt, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 20, 21: /mod_base = "2'-deoxy-2'-fluoro corresponding base 5'-monophosphorothioate"
uuccgaauaaacuccaggccu

SEQ ID NO: 1471 - RNA, 20 nt, Artificial sequence
  siRNAs to PCSK9
  modified_base 2, 3, 4, 10, 11, 12, 14, 15, 16: /mod_base = "2'-deoxy-2'-fluoro corresponding base"
gccuggagguuuauucggaa

SEQ ID NO: 1472 - RNA, 19 nt, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
uuccgaauaaacuccaggc

SEQ ID NO: 1473 - RNA, 20 nt, Artificial sequence
  siRNAs to PCSK9
  modified_base 2, 3, 4, 10, 11, 12, 14, 15, 16: /mod_base = "2'-deoxy-2'-fluoro corresponding base"
gccuggagguuuauucggaa

SEQ ID NO: 1474 - RNA, 21 nt, Artificial sequence
  siRNAs to PCSK9
  modified_base 1, 3, 5, 7, 9, 11, 13, 15, 17, 19: /mod_base = "2'-O-methyl corresponding base"
  modified_base 2, 4, 6, 8, 10, 12, 14, 16, 18: /mod_base = "2'-deoxy-2'-fluoro corresponding base"
  modified_base 21: /mod_base = "2'-O-methyl corresponding base 5'-monophosphorothioate"
  modified_base 20: /mod_base = "2'-deoxy-2'-fluoro corresponding base 5'-monophosphorothioate"
uuccgaauaaacuccaggccu

SEQ ID NO: 1475 - RNA, 20 nt, Artificial sequence
  siRNAs to PCSK9
  modified_base 2, 3, 4, 10, 11, 12, 14, 15, 16: /mod_base = "2'-deoxy-2'-fluoro corresponding base"
gccuggagguuuauucggaa

SEQ ID NO: 1476 - RNA, 21 nt, Artificial sequence
  siRNAs to PCSK9
  modified_base 20, 21: /mod_base = "2'-O-methyl corresponding base 5'-monophosphorothioate"
uuccgaauaaacuccaggccu

SEQ ID NO: 1477 - RNA, 20 nt, Artificial sequence
  siRNAs to PCSK9
  modified_base 2, 3, 4, 10, 11, 12, 14, 15, 16: /mod_base = "2'-deoxy-2'-fluoro corresponding base"
gccuggagguuuauucggaa

SEQ ID NO: 1478 - RNA, 19 nt, Artificial sequence
  siRNAs to PCSK9
  modified_base 6, 7, 10, 11, 17, 18, 19: /mod_base = "2'-O-methyl corresponding base"
uuccgaauaaacuccaggc

SEQ ID NO: 1479 - RNA, 20 nt, Artificial sequence
  siRNAs to PCSK9
  modified_base 2, 3, 4, 10, 11, 12, 14, 15, 16: /mod_base = "2'-deoxy-2'-fluoro corresponding base"
gccuggagguuuauucggaa

SEQ ID NO: 1480 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uuccgaauaaacuccaggctt

SEQ ID NO: 1481 - RNA, 20 nt, Artificial sequence
  siRNAs to PCSK9
  modified_base 2, 3, 4, 10, 11, 12, 14, 15, 16: /mod_base = "2'-deoxy-2'-fluoro corresponding base"
gccuggagguuuauucggaa

SEQ ID NO: 1482 - DNA, 21 bp, Artificial sequence
  siRNAs to PCSK9
  modified_base 8, 15: /mod_base = "2'-O-methyl corresponding base"
  modified_base 21: /mod_base = "5'-thio thymidine"
  modified_base 1, 2, 3, 4, 5, 6, 7, 9, 10, 11, 12, 13, 14, 16, 17, 18, 19: /mod_base = "2'-hydroxy corresponding base"
uuccgaauaaacuccaggctt

SEQ ID NO: 1483 - RNA, 20 nt, Artificial sequence
  siRNAs to PCSK9
  modified_base 2, 3, 4, 10, 11, 12, 14, 15, 16: /mod_base = "2'-deoxy-2'-fluoro corresponding base"
gccuggagguuuauucggaa

SEQ ID NO: 1484 - DNA, 21 bp, Artificial sequence
  siRNAs to PCSK9
  modified_base 1, 3, 8, 14, 15: /mod_base = "2'-O-methyl corresponding base"
  modified_base 21: /mod_base = "5'-thio thymidine"
  modified_base 2, 4, 5, 6, 7, 9, 10, 11, 12, 13, 16, 17, 18, 19: /mod_base = "2'-hydroxy corresponding base"
uuccgaauaaacuccaggctt

SEQ ID NO: 1485 - DNA, 21 bp, Artificial sequence
  siRNAs to PCSK9
  modified_base 2, 4, 6, 8, 10, 12, 14, 16, 18: /mod_base = "2'-O-methoxyethyl corresponding base"
  modified_base 21: /mod_base = "5'-thio thymidine"
  modified_base 1, 3, 5, 7, 9, 11, 13, 15, 17, 19: /mod_base = "2'-hydroxy corresponding base"
gccuggaguuuauucggaatt

SEQ ID NO: 1486 - RNA, 21 nt, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 20, 21: /mod_base = "2'-deoxy-2'-fluoro corresponding base 5'-monophosphorothioate"
uuccgaauaaacuccaggccu

SEQ ID NO: 1487 - RNA, 19 nt, Artificial sequence
  siRNAs to PCSK9
  modified_base 2, 4, 6, 8, 10, 12, 14, 16, 18: /mod_base = "2'-O-methoxyethyl corresponding base"
gccuggaguuuauucggaa

SEQ ID NO: 1488 - RNA, 21 nt, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 20, 21: /mod_base = "2'-deoxy-2'-fluoro corresponding base 5'-monophosphorothioate"
uuccgaauaaacuccaggccu

SEQ ID NO: 1489 - RNA, 19 nt, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
gccuggaguuuauucggaa

SEQ ID NO: 1490 - RNA, 21 nt, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 20, 21: /mod_base = "2'-deoxy-2'-fluoro corresponding base 5'-monophosphorothioate"
uuccgaauaaacuccaggccu

SEQ ID NO: 1491 - DNA, 21 bp, Artificial sequence
  siRNAs to PCSK9
  modified_base 2, 4, 6, 8, 10, 12, 14, 16, 18: /mod_base = "2'-O-methyl corresponding base"
  modified_base 1, 3, 5, 7, 9, 11, 13, 15, 17, 19: /mod_base = "2'-deoxy-2'-fluoro corresponding base"
  modified_base 21: /mod_base = "5'-thio thymidine"
gccuggaguuuauucggaatt

SEQ ID NO: 1492 - RNA, 21 nt, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 20, 21: /mod_base = "2'-deoxy-2'-fluoro corresponding base 5'-monophosphorothioate"
uuccgaauaaacuccaggccu

SEQ ID NO: 1493 - DNA, 21 bp, Artificial sequence
  siRNAs to PCSK9
  modified_base 2, 4, 6, 9, 11, 13, 15, 17, 19: /mod_base = "2'-O-methyl corresponding base"
  modified_base 22: /mod_base = "5'-thio thymidine"
  modified_base 1, 3, 5, 8, 10, 12, 14, 16, 18, 20: /mod_base = "2'-hydroxy corresponding base"
gccuggaguuuauucggaatt

SEQ ID NO: 1494 - RNA, 21 nt, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 20, 21: /mod_base = "2'-deoxy-2'-fluoro corresponding base 5'-monophosphorothioate"
uuccgaauaaacuccaggccu

SEQ ID NO: 1495 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gccuggaguuuauucggaatt

SEQ ID NO: 1496 - RNA, 21 nt, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 20, 21: /mod_base = "2'-deoxy-2'-fluoro corresponding base 5'-monophosphorothioate"
uuccgaauaaacuccaggccu

SEQ ID NO: 1497 - DNA, 21 bp, Artificial sequence
  siRNAs to PCSK9
  modified_base 2, 3, 4, 9, 10, 11, 13, 14, 15: /mod_base = "2'-O-methyl corresponding base"
  modified_base 21: /mod_base = "5'-thio thymidine"
  modified_base 1, 5, 6, 7, 8, 12, 16, 17, 18, 19: /mod_base = "2'-hydroxy corresponding base"
gccuggaguuuauucggaatt

SEQ ID NO: 1498 - RNA, 21 nt, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 20, 21: /mod_base = "2'-deoxy-2'-fluoro corresponding base 5'-monophosphorothioate"
uuccgaauaaacuccaggccu

SEQ ID NO: 1499 - RNA, 19 nt, Artificial sequence
  siRNAs to PCSK9
  modified_base 2, 3, 4, 9, 10, 11, 13, 14, 15: /mod_base = "2'-O-methyl corresponding base"
gccuggaguuuauucggaa

SEQ ID NO: 1500 - RNA, 21 nt, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 20, 21: /mod_base = "2'-deoxy-2'-fluoro corresponding base 5'-monophosphorothioate"
uuccgaauaaacuccaggccu

SEQ ID NO: 1501 - RNA, 20 nt, Artificial sequence
  siRNAs to PCSK9
  modified_base 2, 3, 4, 10, 11, 12, 14, 15, 16: /mod_base = "2'-deoxy-2'-fluoro corresponding base"
gccuggagguuuauucggaa

SEQ ID NO: 1502 - RNA, 21 nt, Artificial sequence
  siRNAs to PCSK9
  modified_base 1, 2, 3, 4, 8, 12, 13, 14, 15, 19: /mod_base = "2'-deoxy-2'-fluoro corresponding base"
  modified_base 20, 21: /mod_base = "2'-deoxy-2'-fluoro corresponding base 5'-monophosphorothioate"
uuccgaauaaacuccaggccu

SEQ ID NO: 1503 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
gccuggaguuuauucggaatt

SEQ ID NO: 1504 - DNA, 21 bp, Artificial sequence
  siRNAs to PCSK9
  modified_base 21: /mod_base = "5'-thio thymidine"
  modified_base 1..19: /mod_base = "2'-hydroxy corresponding base"
uuccgaauaaacuccaggctt

SEQ ID NO: 1505 - RNA, 3636 nt, Human
  PCSK9 mRNA
cagcgacgucgaggcgcucaugguugcaggcgggcgccgccguucaguucagggucugagccuggaggagugagccaggcagugagacuggcucgggcgggccgggacgcgucguugcagcagcggcucccagcucccagccaggauuccgcgcgccccuucacgcgcccugcuccugaacuucagcuccugcacaguccuccccaccgcaaggcucaaggcgccgccggcguggaccgcgcacggccucuaggucuccucgccaggacagcaaccucuccccuggcccucaugggcaccgucagcuccaggcgguccugguggccgcugccacugcugcugcugcugcugcugcuccugggucccgcgggcgcccgugcgcaggaggacgaggacggcgacuacgaggagcuggugcuagccuugcguuccgaggaggacggccuggccgaagcacccgagcacggaaccacagccaccuuccaccgcugcgccaaggauccguggagguugccuggcaccuacgugguggugcugaaggaggagacccaccucucgcagucagagcgcacugcccgccgccugcaggcccaggcugcccgccggggauaccucaccaagauccugcaugucuuccauggccuucuuccuggcuuccuggugaagaugaguggcgaccugcuggagcuggccuugaaguugccccaugucgacuacaucgaggaggacuccucugucuuugcccagagcaucccguggaaccuggagcggauuaccccuccacgguaccgggcggaugaauaccagccccccgacggaggcagccugguggagguguaucuccuagacaccagcauacagagugaccaccgggaaaucgagggcagggucauggucaccgacuucgagaaugugcccgaggaggacgggacccgcuuccacagacaggccagcaagugugacagucauggcacccaccuggcagggguggucagcggccgggaugccggcguggccaagggugccagcaugcgcagccugcgcgugcucaacugccaagggaagggcacgguuagcggcacccucauaggccuggaguuuauucggaaaagccagcugguccagccuguggggccacugguggugcugcugccccuggcggguggguacagccgcguccucaacgccgccugccagcgccuggcgagggcuggggucgugcuggucaccgcugccggcaacuuccgggacgaugccugccucuacuccccagccucagcucccgaggucaucacaguuggggccaccaaugcccaagaccagccggugacccuggggacuuuggggaccaacuuuggccgcuguguggaccucuuugccccaggggaggacaucauuggugccuccagcgacugcagcaccugcuuugugucacagagugggacaucacaggcugcugcccacguggcuggcauugcagccaugaugcugucugccgagccggagcucacccuggccgaguugaggcagagacugauccacuucucugccaaagaugucaucaaugaggccugguucccugaggaccagcggguacugacccccaaccugguggccgcccugccccccagcacccauggggcagguuggcagcuguuuugcaggacuguauggucagcacacucggggccuacacggauggccacagccgucgcccgcugcgccccagaugaggagcugcugagcugcuccaguuucuccaggagugggaagcggcggggcgagcgcauggaggcccaagggggcaagcuggucugccgggcccacaacgcuuuugggggugagggugucuacgccauugccaggugcugccugcuaccccaggccaacugcagcguccacacagcuccaccagcugaggccagcauggggacccguguccacugccaccaacagggccacguccucacaggcugcagcucccacugggagguggaggaccuuggcacccacaagccgccugugcugaggccacgaggucagcccaaccagugcgugggccacagggaggccagcauccacgcuuccugcugccaugccccaggucuggaaugcaaagucaaggagcauggaaucccggccccucaggagcaggugaccguggccugcgaggagggcuggacccugacuggcugcagugcccucccugggaccucccacguccugggggccuacgccguagacaacacguguguagucaggagccgggacgucagcacuacaggcagcaccagcgaaggggccgugacagccguugccaucugcugccggagccggcaccuggcgcaggccucccaggagcuccagugacagccccaucccaggaugggugucuggggagggucaagggcuggggcugagcuuuaaaaugguuccgacuugucccucucucagcccuccauggccuggcacgaggggauggggaugcuuccgccuuuccggggcugcuggccuggcccuugaguggggcagccuccuugccuggaacucacucacucugggugccuccuccccagguggaggugccaggaagcucccucccucacuguggggcauuucaccauucaaacaggucgagcugugcucgggugcugccagcugcucccaaugugccgauguccgugggcagaaugacuuuuauugagcucuuguuccgugccaggcauucaauccucaggucuccaccaaggaggcaggauucuucccauggauaggggagggggcgguaggggcugcagggacaaacaucguuggggggugagugugaaaggugcugauggcccucaucuccagcuaacuguggagaagccccugggggcucccugauuaauggaggcuuagcuuucuggauggcaucuagccagaggcuggagacaggugcgccccugguggucacaggcugugccuugguuuccugagccaccuuuacucugcucuaugccaggcugugcuagcaacacccaaagguggccugcggggagccaucaccuaggacugacucggcagugugcaguggugcaugcacugucucagccaacccgcuccacuacccggcaggguacacauucgcaccccuacuucacagaggaagaaaccuggaaccagagggggcgugccugccaagcucacacagcaggaacugagccagaaacgcagauugggcuggcucugaagccaagccucuucuuacuucacccggcugggcuccucauuuuuacggguaacagugaggcugggaaggggaacacagaccaggaagcucggugagugauggcagaacgaugccugcaggcauggaacuuuuuccguuaucacccaggccugauucacuggccuggcggagaugcuucuaaggcauggucgggggagagggccaacaacugucccuccuugagcaccagccccacccaagcaagcagacauuuaucuuuugggucuguccucucuguugccuuuuuacagccaacuuuucuagaccuguuuugcuuuuguaacuugaagauauuuauucuggguuuuguagcauuuuuauuaauauggugacuuuuuaaaauaaaaacaaacaaacguuguccu

We claim:

1. A double-stranded ribonucleic acid (dsRNA) for inhibiting the expression of a human proprotein convertase subtilisin kexin 9 (PCSK9) gene in a cell, wherein said dsRNA comprises at least two sequences that are complementary to each other and wherein a sense strand comprises a first sequence and an antisense strand comprises a second sequence comprising at least 15 contiguous nucleotides of SEQ ID NO:1230.

2. The dsRNA of claim 1, wherein said first sequence comprises SEQ ID NO:1229 and said second sequence comprises SEQ ID NO:1230.

3. The dsRNA of claim 1, wherein said dsRNA comprises at least one modified nucleotide.

4. The dsRNA of claim 2, wherein said dsRNA comprises at least one modified nucleotide.

5. The dsRNA of claim 3, wherein said modified nucleotide is chosen from the group of: a 2'-O-methyl modified nucleotide, a nucleotide comprising a 5'-phosphorothioate group, and a terminal nucleotide linked to a cholesteryl derivative or dodecanoic acid bisdecylamide group.

6. The dsRNA of claim 3, wherein said modified nucleotide is chosen from the group of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide.

7. The dsRNA of claim 1, wherein said sense strand consists of SEQ ID NO:1229 and said antisense strand consists of SEQ ID NO:1230.

8. The dsRNA of claim 6, wherein said first sequence comprises SEQ ID NO:1229 and said second sequence comprises SEQ ID NO:1230.

9. A cell comprising the dsRNA of claim 1.

10. A pharmaceutical composition for inhibiting the expression of the proprotein convertase subtilisin kexin 9 (PCSK9) gene in an organism, comprising a dsRNA and a pharmaceutically acceptable carrier, wherein the dsRNA comprises at least two sequences that are complementary to each other and wherein a sense strand comprises a first sequence and an antisense strand comprises a second sequence comprising at least 15 contiguous nucleotides of SEQ ID NO:1230 and wherein said dsRNA is capable of causing a decrease in serum lipid levels.

11. The pharmaceutical composition of claim 10, wherein said first sequence of said dsRNA comprises SEQ ID NO:1229, and said second sequence of said dsRNA comprises SEQ ID NO:1230.

12. A vector for inhibiting the expression of a proprotein convertase subtilisin kexin 9 (PCSK9) gene in a cell, said vector comprising a regulatory sequence operably linked to a nucleotide sequence that encodes at least one strand of the dsRNA of claim 1.

13. A cell comprising the vector of claim 12.

14. The dsRNA of claim 1, wherein said dsRNA, upon contact with a cell expressing said PCSK9 gene, inhibits expression of said PCSK9 gene.

15. The dsRNA of claim 14, wherein said contact is performed in vitro at 30 nM or less.

16. The dsRNA of claim 1, wherein said dsRNA, upon contact with HepG2 cells expressing PCSK9, inhibits expression of said PCSK9 gene by at least 20%.

17. The pharmaceutical composition of claim 10, wherein said dsRNA, upon contact with a cell expressing said PCSK9, inhibits expression of said PCSK9 gene.

18. The dsRNA of claim 1, wherein administration of said dsRNA to an animal results in a decrease in total serum cholesterol.

19. The pharmaceutical composition of claim 10, wherein administration of said pharmaceutical composition to an animal results in a decrease in total serum cholesterol.

20. The dsRNA of pharmaceutical composition of claim 10, wherein said sense strand consist of SEQ ID NO:1229 and said antisense strand consist of SEQ ID NO:1230.

\* \* \* \* \*

UNITED STATES PATENT AND TRADEMARK OFFICE
CERTIFICATE OF CORRECTION

| | |
|---|---|
| PATENT NO. | : 7,605,251 B2 |
| APPLICATION NO. | : 11/746864 |
| DATED | : October 20, 2009 |
| INVENTOR(S) | : Pamela Tan et al. |

Page 1 of 1

It is certified that error appears in the above-identified patent and that said Letters Patent is hereby corrected as shown below:

In claim 10, Column 136, line 42, delete "the" after "expression of" and replace with --a--.

Signed and Sealed this

Sixteenth Day of March, 2010

David J. Kappos
*Director of the United States Patent and Trademark Office*

UNITED STATES PATENT AND TRADEMARK OFFICE
CERTIFICATE OF CORRECTION

PATENT NO.       : 7,605,251 B2                         Page 1 of 1
APPLICATION NO.  : 11/746864
DATED            : October 20, 2009
INVENTOR(S)      : Pamela Tan et al.

It is certified that error appears in the above-identified patent and that said Letters Patent is hereby corrected as shown below:

In The Specification

On column 122, please replace the antisense strand sequence of Duplex AD-9680, identified by SEQ ID NO: 1230, with the following -- AAGcAAAAcAGGUCuAGAATsT --.

Signed and Sealed this
Eighteenth Day of November, 2014

Michelle K. Lee
*Deputy Director of the United States Patent and Trademark Office*